United States Patent 10,233,495 (METHODS AND COMPOSITIONS FOR SCREENING AND TREATING DEVELOPMENTAL DISORDERS) - sequence listing, part 165

SEQ ID NO: 980 - DNA, 519498 bp, Homo sapiens
  misc_feature (279681)..(379680): n is a, c, g, or t
agctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttttttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgacacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatctgaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaggatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggctgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaaccatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaatattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctaccgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaggtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttactcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaagggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataattgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttttaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaaccattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacaaaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcactcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtgtgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagaataggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaataatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattaaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtagatatctataagataaaacaaatctatacattgtgtttttcagctagaggcagaaactcattgtcactatatcctagataaaatcttcttgatgttattaatcctacggattaatacgaaagtgcaggaaattatcgggtcatggaagagtcacagaaagtgcaggaaattatggggtatattttaataaaattactgaagacacatagataatatcttcacctatattataaaagtgctgagtctaggcctagcatttttcttcgcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctatagtggatctacagtatataggccaagatcttatgatgcacagggcagccccctacaacaaagaattaaatggttcaatatgttagtggtgccaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacactacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaagcttgagaatgattgggagtgaacaaagtgcactgggttttggcaagaaaatacctcatgaattttgggagatatgagtttagcataaattaaaaatagtgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcatcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctcctactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatcttaacaatggagtggacattatttagataacttgtggttctttcctaggcacccaactttttgctcaaagtagttaggaacaaattatcttcccaaatattattgttctaaacatatgtagtctaagattctgtatcactatcttttttttttttttttgagacagagtctccttgttgagacagagtctccaggcagaagtgcaatggtgcgatcttggctcactgcaacctctgcctcacaggttcaagcgattctcctgcctcagcctccccagtgattgggactacaggtgcccgcctaatttttccatttttagtagagacagggtttcaccatgttggccaggctggtctcaaactcttgacctcaggtgatctgccctcctcggcctccgaaagtgctgggattacaggtgtaagccaccgcacccggtatcccccgctttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcttcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtaggttgtgtaattttttgtttacttttctttgaaataattatatatctacaggaagttgcaaagatagtacagaggagtcacaacatctcacccagttttctccaatgattacatctcacataactatagttcaatataagatctgggaaactgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggctttttgttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaactgtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcttagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaatttttggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccgtccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccacttataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattatggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggaatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgtttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagaggtgccatacacttttaaacaatccgatctcacaagagctcactcactattgcaaagataactccaagccgtgagtgattggctcccatgacctgaacacctcccaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccaaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaaaaaaaaaaaaaaaaaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcatcttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaaattcttccattctttacctgttacccagttgccaagtcgctttcacattttccaatatctttatagcaatgccacactcatagttaccaattttctgtgttaggctgttcttgcattgctattaagaaatatctgaggctgggtaatttattagaaaagatgtttaattggctcatggcttttcagactttatagtaagcctgatgctggcattaacttagctcctagggaggcatcaggaagcttataatcatggtgggaggtgaaaggggagcaggaacatcatgtggtgaaagcaggagcgagagagagagagagtgggaggaggtgccacacacttttaaacaaccagatatcgtgacagttcacttgctatcgcaaagacagcactatgctgtcagggatccgttacccaaacaactcccaccagcctcacttccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttcctgtgcagaagctctttagtttaattagatcccagttgtcaatttttgttttagttgcaattgcttttagggtctttgttataaaagctttgctaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatacccagcaccatttattgagtagggagtcctttccccatttcttgttatggtcagctttgtcaaagatgagatggttgtagacatgcagctttacttctggcttctctatttggttccattgatctatgtgtctactttttttgtactagcaccatgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgaccaggctggagtgcagtgccacaactatagttcactgcagccttgaactcctgggctcaagcgatcctcccacttcagtctcctgagtagcggggactataggcattcaccaccacacatggctaattttttagatttttggtagagatggagtcttgccatgttgctcatgctggtcttgaactcctgagctcaagcaatcctcctgcctctgcctcctaaagtgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttaatgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtagtgagagtgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggttttgccatgttggtcaggctggtcttgaacacttgacctcaggtgatccacacatctcggcctcccaaagtgctgggattacaggcatgagccaccgtgcccagccatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccttgttggctgtttttttaaaattactggttcaattttggaactcattatttatcttctcaggtattcaatttcttcctggttcaatattgggagtttgtgtttccaagaatttatccattccttctagattttctagtttgtgtgcacagaggtgtttacaatcatctttgaaattttttgtaaaaaatatttctcttccctttggcatttctgatggtgcttatttgaaagttctttcttttttttctttgttagtcttgctagcagtgtatcaatcttatttattctttcaaagaacaagttgtttggtttcattgatcttttatatggatttttgtgtctctatttcattcagttcagctctaattttggttatttttgtcttgtgctagtttaggggttcacttactcttgtttttctagttcctcaaggtgtgatgctacattgttaatttaagatatttatatcttttcgatgttggcattttgccccataaactttcctgttaatactgctttacctgtgtcccagaaattctggcatgttgtatctttattttcattaatttcaaagaatttcttgctttctgtcttaatttcattctttactcaaaagacattcaggagcaggctgtttaatttccatgtaattgtataattttgagagatcttggtattgatttctatttttattgcactgtggtctgagagtgtgattggaatgatttttaaaaatttgtttagaattgctttatggccaagtgcatggttgatcttagagtatgtgccatacatatgcagatgaaaagaatgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgtttttcatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggtgcaatctgagctcactacatcctctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaagaatgctggctgagtataggtccccaatctcttttggcttataaggtttctgctgaaggttctgctgttatcctgatatcaccccctttgtatgtgacctgtccctttgctctactgcttttaagattttttctttcatgttgaccttggagaatctgacgacaaggcgtctggaggatgggtgtcttgtatgttatatctctggggttctctgaatttcttgaatttgtatgttaacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctaactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgcccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtcgtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaagtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatttactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgtgttgtggaatgggagggaacgaagagttcaaacaattgactggaaaggttttattcatctaagactttcccaaacagcaaatccttgaagggaatgagatccaggtgttagtgtacagtctagtcatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaagtaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaatatgtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcacatgtgcagacagatgtgatttcaacaactagactgtaaactccatgagggtggggacactaactggttcatttttatatccttcacagttcacaggaaactataatattgtttatggcagttgttctataaagatttattaaataaaaataaagagtaataaaagcaaacaaataaatatacgtgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctttatacctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtctctaacacattaatcagtacctctttggcgtagatgtagtcagcttaaattttacaatcactgtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatacaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttaaatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaatcaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccaggcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactacccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagaaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaagtagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcattggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacataaacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcttggtataaggcagaaaacattaaaagggtaaactgacccttttatgctctaagatataaacctctgtcatctcactgactaatgttttaaatgctagagtgaaagcaagtaaacattggctttggctgtgaatattctggtggcacacatttatgtcgttgatgaatagtgtaccttgaaaagccttaacccttacgccgttagcatttcatcttgttcatctgactgcccaaacatctatatttaaacaaatccacaggggatctgttctctaggactttgctggagaaccttgatgtgtcggaaaactgttcctattaatagaggaattatatctcgagtggctggcatatgttaactaatggatactattaatagtaataacaaaaataaaaaatcattacaatattactactatttgaatcactgactatgtatgagagacattataagtgttttatctatgttaagtatatttccaacacgacacaataggaggtaattgccattattatagaagtaggcataattatctctatcaacattctagtccacttttccatcattatctgttgcataaactcatgcaaaatcttctaaatgatctacacttttcacaatctggcctttttgcgatgtaatccattgacaacattgagagctttttaaagaaagggaatctgataatatctctccatttctgaactctgtgcagtagctcccctttgcccttaatagatacttagatctccttatagttatattgcttcaacttacctctctagcatcatctgctactttactcagctttttcctgcatactaatttgaaaccttaggcactgcctttacttcactacctgcttttctttttgtgttttcctctccccctcatcttttcatctactcctagacattattgaggactcactttatcaatgactttgagatctcttctacatgtttccttagcattgtgaccttataacacttttagacttttcctttttacttgcttatagtctatctttcaaagtacaacgtaaggcatgagggagcagaaagtgcctacatttcttctctgaaaatccagcacttatccgtggtttgtgctgatcaattcataaatattccttgaaggaatgacttatttttttttttacattgcacaatgaaggctttcattgaatcaaccctgttttcagagtctctttagtatccctctttgatatttaatgacactaaagtttacacagttgtgatgatatagcaacatatgagtttctaatggtaggtcactttctttgacctcccgtatttctctcactgtgagtcaaacactctgaatgaaaacatatctggccattccttctgaaatgcaaagcaaataaatcaaacatgaatacatttaccttaggcagggttttggctggtttacagtggagttcccccacaaaatcgacatttggtaagggtgggtgaagaaattcaaaatcccagtacgtttgaatgagccacacttcagctttccccattgtctcaaataatgtacattaataaaataaatatatacatatatttttatatataagcataacaattttatatattgcatattacttatatataaggaaagcaaaatgttcagagaattaagaggaaattacatatatttttttctttttcttttttttattatactttaagttttagggtacatgtgcacattgtgcaggttagttacatatgtatacatgtgccatgctggtgcactgcacccactaactcgtcatctagcattaggtatatctcccaatgctatccctgccccctgcccctaccccaccacagtccccagagtgtgatattccccttcctgtgtccatgtgatctcattgttcaattcccacctatgagtgagaatatgtggtgtttggttttttgttcttgcgatagtttactgagaatgatgatttccaatttcatccatgtccctacaaaggacatgaactcatcattttttatggctgcatagtattccatggtatatatgtgccacattttcttaatccagtctatcattgttggacatttgggttggttccaagtctttgctattgtgaataatgtcacaataaacatacgtgtgcatgtgtctttatagcagtatgatttttagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttttttcctgactttttaatgattgccattctaactggtgtgagatggtatctcattgtggttttgatttgcatttctctgatggccagtgatgatgagcattttttcatgtcttttttggctgcataaatgtcttcttttgagaagtgtctgttcatgtcctttgcccactttttgatggggttgtttgtttttttcttgtaaatttgtttgagttcattgtagattctggatattagccctttgtcagttgagtaggttgcaaaaattttctcccattctgtaggttgcctgttcactctgatggtagtttcttttgctgtgcagaagctctttagtttaattagatcccatttgtcaattttggcttttcttgccattgcttttggtgttttagacatgaagtccttgcccatgcctatgtcctgaatggtaatgcctagattttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcgttatttctgagggctctgttgtgttccattgatctatatctctgttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaagtagttttttccaattctgtgaagaaaggcattggtagcttgatggggatggcattgcatctgtaaattaccttgggcagtatggccattttcacgatatcgattcttcctacccatgagcagggaatgttcttccatttgtttgtatcctcttttatttccttgagcagtggtttgcagttctccttgaagaggtccttcatatcccttgtaatttggattcctaggtatttaattctctttgaagcaattgtgaatgggagttcactcatgatttggctctctgtttgtctgttgttggtgtataagaatgcttgtgattttggtacattgattttgtatcctgagactttgctaaagttgcttatcagcttaaggagattttgggctgagacaatggggttttctagatatacaatcatgtcttctgcaaacagggacaatttgacttcctcttttcctaattgaataccctttatttccttctcctgcctcattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgtgtatattgaaccagccttgcatcccagggatgaagcccacttgatcatggtggatacgctttttgatgtgctgctggattcgatttggcagtattttattgaggatttttgcatcaatgttcatcaaggatattggtctaaaattctcttttttggttgtgtctctgcctggctttggtattagaatgatgctggcctcataaaatgagttagggaggattccctctttttctattgattggaatagtttcagaaggaatggtaccagttcctccttgtacctctggtagaattcggctgtgaatccatctggtcctggactcttttttgttggtaagctattgattattgccataatttcagatcctgttattggtctattcagagattcaccttcttcctggtttagtcttgggagagtgtatgtgtcgaggaatttatccatttcttctagattttctagtttatttgcgtagaggtgtttgtagtattctctgatggtagtttgtatttctgtgggatcagtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttattttaattgtgatgttagggtgtcaattttggatctttcctgctttctcttgtgggcatttagtgctataaatttccctctacacactgctttaaatgcgtcccagagattctggtatgttgtgtctttgttctcattggtttcaaagaacatctttatttctgccttcattttgttatgtacccagtagtcattcaggagcaggttgttcagtttccatgtagttgagcggttttgagtgagattcttaatcctgagttctactttgattgtactgtggtctgagagatagtttgttgtaatttctgttcttttacatttgctgaggagagctttacttccaagtacgtggtcaattttggaataggtgtggtgtggtgctgaaaaaaatgtatattctgttgatttggggtggagagttttgtagatgtctattaggtccgcttggtgcagagctgagttcaattcctgggtatccttgttgactttctctctcgttgatctgtctaatgttgacagtggggtgttaaagtctcccattattaatgtgtgggagtctaagtctctttgtaggtcacttaggacttgctttatgaatctgggtgctcctgtattgggtgcatgtatatttaggatagttagctcttcttgttgaattgatccctttaccattatgtaatgaccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgggatgggtttcctgaatacagcacactgatgggtcttgactttttatccaatttgccagtctgtgtcttttaattggagcatttagtccatttacatttaaagttaatattgttatgtgtgaatttgatcctgtcattatgatgttagctggttattttgctagttagttgatgcagtttcttcctagtctcaatggtctttacattttggcatgattttgcagcagctggtaccggttgttcctttccatgtttagcatttccttcaggagctcttttagggcaggactggtggtgacaaaatctttcagcatttgcttgtctgtaaagtattttatttctccttcacttatgaaacttagtttggctggatatgaaattctgggttgaaaattcttttctttaagaatgttgagtattggcccccactctcttctggcttgtagggtttctgccgagagatccactgttagtctgatgggcttccctttgagggtaagcccacccttctctctgtctgcccttaacatttttttcttcatttcaactttggtgaatctgacaattatgtgtcttggagttgctcttctcgaggagtatctttgtggcgttctttgtatttcctgaatctgaatgttggcctgccttgctagattggggaagttctcctggataataccctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtgttggttattctagttatacattcttctaaatttttttcaaagttttcaacttatttgcctttggtttgaatgtcctcccgtacctcagagtaatttgatcgtctgaagccttcttctctcagctcgtcaaagtcattctccatccagctttgttccgttgctggtgaggaactatgttcctttggaggaggagaggcgctctgctttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggaataccccaccgtgtgaggtgtcagtgtgcccctgctgcggggtgcctctcagttaggctgcttgggggtcaggggtcagggacccacttgaggaggcagtctgcccgttctcagatctccagctgcgtgctgggagaaccactgctctcttcaaagctgtcagacagggacatttaagtctgcagaggttactgctgtctttttgtctgtgccctgcccccagaggtggagcctacagaggcaggcaggcctccttgagctgtggtgggctccacccagttcgagcttccctgttgctttgtttacctaagcaagcctgggcaatggcgggcgcccctcccccagcctcactgccaccttgcagtttgatctcagactgctgtgctagcaatcagcgagactccatgggcgtaggaccctccgatccaggtgcgggatataatctcgtggtgcaccattttttaagcccgtcggaaaagcccagtatttgggtgggagtgacccgattttccaggtacgtccctcacccctttctttgactcggaaagggaactccctgaccccttgtgcttcccaagtgaggcattgcctcgccctgctttggctcacgcatggtacgcgcacccactgacctgtgcccactgtctggcactccctagtgagatgaacccggtacctcagatggaaatgcagaaatcacctgtcttctgcgtcgctcacactgggagctgtagacctgagctgttcctattcggccatcttcggaaattacatatttaatgtaacattagtatattcacaatctcaaatagttattaaaataagccactatggacttaaatatgcatttgtttcctctctgaaactgcagtagtaactgatatacatttaaacagctctttgagctccaggatgaattcatcttactatactcataaaaacagctttctacgaagtgcacaatctcgtttccacaatttatcaagtcagtcccttgatccttggttctccaagtgaactgtgagttttctgagagtatgcctgaaatccttgaacatactactgcttctagttcacgttaagattttaacaatattagctttaaaatacatacattaaaaatgatagctagtatattttcagaatttattgaaacagagatatgtgctcccccttaacttggcccatattttccctaataaagagatgtagttaataaagtatagattaaaagcttgaatgttcactttcaacaagattttaattcacaaagcaaataatttctcagttgttagtgaatgatatacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattgatagttatgctagaaatatgtgtagctcctcatctaaatgtctgccttcatcaagttgtttattgatatatgttttgccttttttaaagatgaaaaaagtatagtaaaatacgtatatagttgcttaaagaaatcataagtgctttactttgtagtttttttttttttaattcctgtagtgtcctataggagtgatgaccaaagggttctagctgagcctataatatcaacatttctataatatttgtgagattgatagatcatcttacatttggcattcatcatttcatttaaacaacactatcctcttacattatatttatatacgctcaccttcaaaggcaaaaggaaagttaggacttattaatcattgattagaaacatgacttacctagaacttcactgtaaaacttctcccacttctcgtatcaaacatttgaaaccaaaagtcaaaataaagcacatgtattagatttttaatcctctccacgaatgtcattttaccacttaattcagacagaacagcaggtatgcgggaaatggggaatggaagtcctccattatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgaaaaatatgaccaaaatgcatcttttggaagatcgtatatccatctattgatcagtttcacaacaagaccctcaaaattatttttaattagagatgttggataaacttcaaatttaatagcagatgatttactagggtcaataataatggaagccgaagatgtcaacacagtcatcttgtggcctctccaaacaagttcatccaggattgtctttatattcatccaatggctgtattctgtgggccacagcagcacctttccacaactcccagagctaaagtaacaactgagttgtatcaggagaatatttgacatcgatttcaatgtcctcctggtgcaatgcaatgtttcttttcaaattgctgtttctttctgtctttctcatacttacatctgagcataaatcaatcaagtgaaagtataactgctacaattcaaagtagcagttaccatataatttctaaattatcataggaattgtctgttaccatacaatttctaaattaccataggaattttcagattgtttttcacagtggttgcttccatttccattctcaccagcaatgtataagaattttaatttcttcccaacattgccaacacttgggattacatttcgtttgattatagccagtgtgaatgaagtgatatctcattatgctttacctttccttgatatgaaatcatgttgagaatgttttgcctagttttgattgaattatttgtcttcttatggacttgtgtttttaatatttttgatgtaagaaccttatcacatgtatgatttccttgtatttttttattctttgggctgtccttttactttcttaatggtgttaattgaagcacaaaagtattgattttaatgaagtccaactaatcaattttaatttggttgcttttatttttgattttatatctcacaaaccatttccaagttatgaaaattagtacctgttatttattattagagttttatagttctagtgcttacatttaagtttttgatcacctatgaattagcttttgtaagtgatttgaggtagagggtcccaacttaattattttgtatacagataatcatttttcccacttatatttgttgaataatctattctttcccctattaaaacgttttgaaacttttgtcaaaaactttaaatgcatgggcatatttctatgttctaaaatcattccattgatctacatgtctatctgtaggcctgtatcacactctcttgattatcatatatttgtatttgtctttaaaggcaggaaatgtaagttttccagcttttttttatttaaattgtttcagttttttttttaatttttttcttcttgtttttttttttttttttttaagagatagaagtcttactatattgcccaggctagattcaaatttctgggctcaagcaatcctcccaacacagcttcttgagtagctggaattacaggtgtgtttcactatacctagcttcttttggctattagtatgtctcttgaatatgtacataaatttcaggatcagtttgtctgtttatacaaagaagcaatctgggattttgatacggattgcattgatttggtatatcagtttggggagtagagtatggtcattatcacaattttaggtctttcaataaatgaaaatgagatgcctttctatttatttagatgttcttatttccacagtgttttgtagattttgttacagtggctagctagtcagacacaaacagggcagaagagggctcccacaccctaccaggaaagtcaggtgaccatcagttaatggccaggcagttgtcacactgtttaaaacaataattggttgcagccagccagggaaaggcagatttcttatagatagaaaaaatcaaatctggtaatcagcagcttcctgataagatctcagcagttgggagagtgggttcacacacacacattaagaggccaaatggtggagtacgacattccgggggcaccagaaaagggaagaatgcctcaggggagcatgcatatgactccagtaaatatactgtgcatgctcatctcctaagtggtagcaggccatcacacatgccagcaggtcattctaaggaaagaatcaaggaaaagggaagcaggacccggaaagtatgccaacatataaaaccctaagtcaaaggtcaaacaccacactttaccttcaaaatggctacttgtatctatcccaagtgtactttcctttctttcctgctataaaactttttaataaattttcacttctgttctgaaacttgtgctggtctctttttctgccttatgccgctcagtcaaattcattcttctgaggaggcaagaattcaggttgctgcagaaccataaatacttgctgcagtaaccaccgctggtaataatgtcacagtaagagttgtacaattttttgataaacttattgctaagaattatattttttcatggtattataggggtgactgtgtaatctttattttagtttaaatttccattgcaattgtgtagattttttgtttgtttatttaccttgtatcccaaaatcttgttttattagtttacttgaatattttttagtggatttgtaaaaattttctattataagatcatgatatatgccaatagagacagtttaacttctttctttctaatgtggattccttttatttcattttctttcctatttgttggctgaaagttctactgcaatattgagtgaaagtgagaagagtcagtttagtgtgatgttagctgtgtgtttttttatagacactattgatcagttttagaatgttcccctttacttctagtttaagtgttcttatcatgaagaatattgaatttcattaagtaagtttttctgcagttatcgaaatgattatgcagttttttcctttattctaatgatatgatatattagttggctttttcagatgttaacataactttgcattcctggaataaagttcatttgtttatggcatttaagcttttcatgtgttcctgaattttgtttgctagtgtgaaaagaaagtaaaaatcttgagtcattaaactcactatgtcaaagagaaaagttaatcttgggaaatgaagcatgtaaaattggctcccattttgttcctaaacagatagctgcaaagatagaaggccacatacctccccagatggcctccttcccaatttactcacaaggaaattcacaaggccctaaaacagagttctcttgaattttaccctgacaatataaattaacattttatattcacaggtatataaaagacaggacttgaagccattgtgtggtttttagcataagggcttactgaatggtggttatgttttctcctcttttattttttggagaattagttattttaaatacttgatagaagtatagagcttttatattttctactctaccatttccagttattacccagctatgtttttctaaataatatttcattggaagccgtcagacactgggcttttcttttatgggagactttttcttacagcttcaatcttgttacttgttattagtttgttcaggttttttatttcttcatgggtctattttggccggttgtatgtgtccaggaatttattaatatcatctaggttttccaaattgttggtatatagttgttcataatattctgtaataatttgtgtttctgtaatctcagtttttatgtctcctctttcacttctgattttatttagtgggtctgttctcactttttcttacttagtctagctaacagtttgttgattttgtttacttttacagagtttaccttattgactatggctgcttttgtactacaatggaagagttgagtaggcacaggagtccaaagggtttgcaaattccaaaaatgtttaccatctgaggctttatagaacctattctgatctctgctctacagtaagcaggttcgttttttcctttaacctttctatatattcaatgcaattttactaaaacagtatagatttttagtgagtgagccagatggtttacgtttaattttgttaataattagttaataaattaatctatttgtatttccattttatttagaataggtgaatttgtttattatgtggaatggtgcttctgttttgccttttttttttgagaaatctctaaactgctttccacagtagttcaactaatttgcattccaccaacagtgtataagcatttccttttctctggatcctcaccagcatatggttttttttttttttttttactttttaataatagctgttatgactagtgcgagatggtctcattgtgattttgatttgcatttctatgatgattagtgatgttgagcatttttgtcatatgtttgttggttccttgtatgtcatcctttgagaagtacctgttcacatcttttgcccagtttttcatagggttacttgatttttgcttgttgaattattcaagtttcttatagattctggatattagacctttaacagatgtgtagcttgctaatatattcttccattcaataggttgtttgtttattctcttgatagtctgctgtgcagaagctcttcagtttacatctcacttgtgaattttgagttttgttgcaattgctattgaggacttagttataaattctttcccaaggctgatgtctagaatggtatttcctagattttcttcaattattcttatagctttaggtcttatatttaaacatttaatccatcatgggttaatttttgcatggtgaaaagtagaggtccagttttgttcttttccttatggctagcaagctatcccaccatcgtttattgaatagggagtccttttctcctttgcttatttttgttgacttagtgatggatgactataggtctgttgctgtatttctgggctctgtattctgtttcattgatttatgtgtctgtttttgtaacagaaccatgctgttttggtatctgcagccttatagtttgaagttgggtaatgtgatgcctctggctttgttctctttgcccaggcatgcttcagctatttggactaacttttggttttatggaaatttttgaatatttttttctaattctgtgaataatgacattggcattttaataggaatagcatttaatgtgtggatggctttggttaggatggttattttaatgatactgattcttccagccttgagcataaaatgttctaccatttgtttgagtcatctatgatttatttcagcagtgctttgtagttcttgtagaaatcttttgtctcctcggttagatgtatttttaagtatattttgtttatgtgactggtgtaaatgtgattttgttcttgatttgattctcagcctgaattcttattggtgtatagaaatggtattgatttttgtacattgattttgcatcttgaaaccctactgaagtcatttttcagttctagcaggctttaggcagtctttaggattttctaggtatagaatcatatcatcaggaaagagagataccttcaattcttttcctgtttggatgccttttatagctttctcttgcctaagtgctcaattagtacattattgaaatagaaagtgctgttattttaatcatttatatttgaaacataaaatttaaaaaatgtattagcctatgttaagtccaaattcattgcggaaatgtactcatccacctaataataataatagttgtagcaaattgaatattactatatacagcaattacttacagcaactcttttagcctcagcaatgctattaagtaggtagtgccattgcctcatctccatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaacatagaatcacatttttttcgtacgtatatattaattataatattattacaggtgtatgattcaaatatgtaaaaatatttttctggttgtctatcactgcttaaccaactgctctcaaatgaaggtgcttagaacagcaacattttatcatcgcctgttttaattctaggttgttggccaggctcaattaggtgtttatggcacagcatttctcaactggttactgtcctaaggtagcttaggctaatcatctgaaggttaatcactcacatatctggtaattagtattaaaagtctcaagctactggagtgctggaccaattgtgacttcttaggcatacatatgtatttctacaccaaatggtatatttctcctggggactgtggatatggcacagggctccaaagtgagtggagagaccgagagaaaggaaaaaaaatgacagaaacacagagaaaaggacagaaggacagacagagaaaatgtattcacaacttttttgagctttggaagttaagctcctcacttccactatattctcttttttaagacagccacaaagtttgctaaatttcacaggaagggtatatgacttgattagaggattgccaatgcatttgtaatcacatcccaaaattactgcaaatataaccttaaaaattagaagaaatcactaaattactatagaattcataaaatgttgacataagacagtaaaatttaaaaaaattttgtatttaaattttaaccatgattaaaaattttaattaacattctaatatatttattcataaatatttaaaatatcaagtaggtgtccaaaaacaatctgtaaatttatcagatagagagtaccagattcctggtcaatttaagttttctaaatggcactaatagattgataatattatattaaaacctaagaacatgctatctcaaatcaatgtttatttcactaattaatttttaaaactatataattaaatataaaaacaaatttgtgcaaggttagtgaatgaagtatgtagaatcaaaattaaaagtagaatcctctatgtttatacagatttacagattcttaattttatttcaaagaagtatactcatttttttctggaacttgtttttcatttagcaatgtgatgtggagaacattccctgatattgtctgtaatatgcctgttctctgtaattacttcataccttctactttttgtgggaggtatgtatgtgcactgactgatagccatgtaagtgatggagggaacaacctgtacatacacgcactcaggtgcaagtgtatctggatagcagatgactagatgtagaattgcagagtcaaactctaagtataattttttttgtaagggttatttcactttatactctctcacaaactcttttctcaggttcttatgtttgatcaatcttctgtgggaaaataattcattgactttttatggctacatagtaatccatggtgtatacatactgcactttccttattcagtctatcattgatggacatttaggttgatttcatgtctttgctattgtgaatagtgttgtaatcaacatatatgtgcatgtgtctttataatagaatgattatattcctttgggtatatacccagtaatgggattgctgggtcaaatggtatttctgtcattaggtcttggaacagacaaccaaatgctgcatgttctcacttacaagtggaagctaaataatgagaacacctggaacacatgaacaacacacactggggcctattggagggtagaaggtgggaggggggagaggatcaagaaaaataagtagtgggttctgggcttaatacctgggtgatgacacatatttgcctatgtaacaaacttgcacatgtacccctgaacttaaaagttaaaaaagttcattgacttaacattattgacttaataaattataatgtccaattttctagtacaagtagcttttgtcatctttttgatgtgattggccatttttacttctgtgaattgtcaattcatatccttcatctattttcatattggtctgtttgtctttttggttggtgatatataatagctctcattgtacaagggataccagtcctttgtctacgtattgcaggataggcttgatgtaaattactttaggttggtatgcatgatgtaacaatattatctgctatgacactatatttattcaatatttcttaaaaatgtttcatttatctggatacattttataaaaattctgctgcaatctcttccaataattcccttagcatcaaagttttaatttatttttagaatacattcatgccataggtcatagagtggttgttgtgagacttggatgatggtcttcttgccaataaagacacaaaggtttttgttaacccatactactttgatcacaaagtgtttccttgatgtgtagcttttaggagggccttgagaattcctgagattttattatttgccatttttttggtaatttttgtgttcttgatattattactgattatgattagttgcaatatgtttacattaaaaatgattatcttatttttagtcatgctaaatgacttatgttttcatattagtgttatgggatgaatagagctacaggcttctgtggaaagagagaaacatgagacatccttatataaaatagggttatatagaataatggtcacttttaactgtcttctacaaacacattcagtttcacaaacatctgtaaggtagctcaataattctgtgccttgttttggaagaagtgaacacatatatacatgtacagttgtgataatcaaaatcggtaagtccccttaaagtgctggttctatattatcacaacctacaattcagacatttaatccactattaacgtttataaatgaccgtgaaagcaaccagttcacactttagaaaagttcatggggaaaagacaattagcttgtgaacaaaggttttcccaaatagttaaattttgtagtatttgtcaggtaggagtcattctatctctaatttgtcatatattgtgcttttgatccttgaacaacatggaggtttgaactgaacctctgattatatgcagattttcttttgcctctgccagcctgagataacaaggccaacttctctttctcttcctcctttgcctacttaatgtgaatacatgaagaagaaaacctttgtgatgatccacttccacttaataaatagtaaacatatttaaccttccttgtgattttcttaataacattttcttttgtctatcttactttattgtaaaactatgatatacaatacatatagcatgcacaatatgtgttaatttactgtttatgttattggtaaggcttctggccaacagtaaactatctgtagttaaattttgtggagtcaaaagttataaatggctttttgatggtgtgataggagagatttgcccgtaggtccactgctgttcacaggtcaactttactgcaaaatgatttaagttggcagaagccaaatgcactgccatatttttttagaaaagaggtgatgttgtagccggatgcacattaaggactagcagcattacttgtctccaaaccacagaggaatatggtggtcccagattttcagttttgttccccaactccatgtatctgagtcccattattttgctcttcaggccctaaatgtggcataaagtgtagtagaggcggacagtgtcgtctcctgtgcatcactgttgttttgcgatgaaattctcaatgtggtcagctgctgctgctgcagaagtcgattttcttcaaacactgccaagaacatctgacttacatagcatattttgatttgatatttattcaaactgagccttttttctttttacaagctctctgaaactgttaaaagtcttcactttataaactatgtagttaccatgatctttatactgttggtaaagcaatgattcactttccccgtgtctttcacctcagttcttttcttccctgtgtgaattgtatccattttgatcaaagtgattttactgaataccaggagttatcacctctcaagtgttgttggcaaggagactgtttttgccagttatcagtgagttattaaattccaaagtcccattttgagggtctgctttttagtgccacttgcccaagctgccatagtctatttttctcagaaagcaaagcctgagataagaattagtgtgcaataactaatttgagaaatgttcttagggtacaggagtaggggacaggaaagggtgaaacaagaagggagaaaagtcagtacaagaatgtgttaccaaactaatcatcaccgtgactgttgggacttaagctcatgtggacccagtaggaagctgtgtggatgtaaggcgtgatcattaaccatcactttctattgttcacactgccaggttatgcacatgtgagtgagtgttagctgagtttctttgacggttccatgaagagatgttaaagaagactggtgcagaaaatgagagacctgtcctatcagaagatgactttacaaagctccttgacacagcaaaggctagagaaaaaaaaattagctgaaaaatatggggtgcaacctaatttgatcaaatgtattagagctttcttttttcttttgtttcattttcacagtatattacatttcatatgattgaatactgtaaattttctcagttttctgataaagttatgtctgtgatacaggaactagaaagaaattattcaggcagatagtgagggtgagagtcctcggtaaggttttgttttaataaaaagcagctccgcaaatcatttccttgctaacaaaaagcagcctgaaaaatcaagcttcaaacatagagaaacaagctaaaagcttgcataggtagggaaaagaaagagagatcagactgttactgtgtctatgtagaaagggaagacataagagactccattttgaaaaagacctgtactttaaacaattgctttgctgagatgttgttaatttgtagctttgccccagccactttgccccagccactttgacccaacctggagctcacaaaaacatgtgttgtatgaaatcaaggtttaagggatctaggactgtgcaggacatgcctttttaacaaaatgtttacaggcagtatacttggtaaaagtcatcaccattctctagtctcaataaaccaggggcacaatgcactgcggaaagccgcagggacctctgcccttgaaagctgggtactgtccaaggtttctctccatgtgatagtctgaaatatggcctcatgggatgagaaagacctggctgtcccccagcctgacacccgtaaagggtctgtgctgaggtggagtagtagaagaggaaagcctcttgcagtcgagatagaggaaggccactatctcccgcctgcccctgggaactgaatgtctcagtataaaatccgattgtacatttcttcaattctgagatgagagaaaaaaaccaccctatggtgggaggtgagacatgtttgcagcaatgctgccttgttattttttactccactgagatgtttgggtggagagaaacataaatctggcttacgtgcacgtccagtcatagtaccttcccttgaacttaattatgacatagattctattgctcacatgtttgttgctgaccttctccttattatcaccctgctctcctactacattccttcctgctgaaataatgaagataataatcaataaaaactgagggaactcagagaccggtgctggtgcagatccttggtatgctgagtgctggtccactgggcctactgttgtttctctatattttgtctctgtgtctcatttctctttctcagtctctcatcccacctgactagaaatacccacaggtgtggagggtcaggccaccccttcacttgctaacaaaaagcagcctgaaaaatcaagcttcaaacatagataaacaagctaaaagcttgcataagtaaatgctggcaactgtgccaataattcctcaaggatctagaactagaaataccatttgacacagcaatcccattactggatatatacccaaaggattctaaatcattctactataaagacacatgcacacatatgtttattgcagcactattcacaatagcaaagacttggagccaacccaaatgtccatcaatgatagactggataaagaaaacgtggcacatatacaccatggaatactatgcatccataaaaaagatgagttcatgtcctttgcagggacatggatgaagctggaaaccatcattttcagcaaactaacacaagaacagaaaaccaaacaccaattgttctcactcataagtgggagttgaacaatgagatcacatagacacagggaggggaacatcacacactggggcccgttgaggtgtgggggactaggggagggatagcatcaggagaaatatctaatggaggtgatgggttgatggttgcagcaaaccactgtggcacatgtatgcctatgtaacaaaactgcatattctgcacatgtaccccagaacttaaagtataattaaaaaaaaaaaaaagaaagaaaagggatgggataccttgaagccaggtatattcaacagggaggttccctctttcctttcctttgtcaaccacacgtgcaataaagaagcaggcaacatggcactggccaggtagagaaagcatatgcataatagaagattagggtggggcagcaagcttcttcttacactatgtaaatggcacccctggttccaccaatcctttgggccctatataaatcagacactgcttcctcaagcttgtctataaaacccagtgcatttcgccatggaactagaagatctatttgggatcacctttctgcaggaaagagagctattctcttttctctttctttcccctattaaacctccattcttaaactcacttctcgtgtgtccgtgttttcagtttccctggagtgagatgatgagtcttgggtatttaccccagacaatgatgctgcttaacctgttacttttatttattcttacttgaaaaatttttatttattttttatttattttacttaaattctgtgatacatgtacagaacgtgcaggtttgttacctaggtacacatgtgccattgtggtttgctgcacccatcgacccatcatctaggttttaagccctgcgtgcattaggtatttgttctaatgctctctgtctccttgtcccagaccccctgacaggctccagtgtgtgatgttcccctctgtgtctatgtgttctcattgttcaactcccatttataagtgagaacatgcagcatttggttttctgttcctttgttagtttgctgagaatgatggtttctatccacatccctgcaaaggacatgaactcatgcttttttatggctgcatagtattccatggtgtatatgtacacattttctttattcggtctatcattgataggcatttgggttgtttccaagtctttgctattgtaaatagtggtgcaataaacatacgtgtgcatgtctctttatagtagaatgatttgtaatcctttgggtatatacccagtaatgggattgctgggtgaaatcgtatttctgcttctagatccttgagcaattgccacaatgtcttccacaatggttgaactaatttgcactgccatcaacagtgtaaaagtgttcctatttctccaaatcctctccagcatctgttgtttcttgactttttaatgattgtcattctaattggcatgagaaggtatcttattgtggatttaatttgtatttctctaatgaccagtgatgatgagctttttttcatatgtttgttggccatgtaaatgtcttcttttgagaagtgtctgtttatagcctttgtgatggtgttgtttgtttttgtcttgtaaatttgtttaagttccttgtagactctagatattagaccgttgtcagagggatagattgcaaaaatgtttgccgattctgtaggttgcctgttccctctgatgatagtttattttgctgtgcagaagctctttagtttaattagatctcatttgtcaattttggcttttgctgcaattgcttttggtgttttagtcatgaagtctttgcccatgcctatgtcttgaatggtattgcctaggttttcttctagtgttcttatggttttgggttttacatttaagtctttaatccatcttgagttaatttttatataaggtgtaagaaaggggaccagtttttgttttctgcatatggatagcaagttttcccagtaccatttattaaatagggaatccttttcccattgcttgtttttgtcaggtttgtcaaagatcagatggttgtagatgtatggtgtatggtgttatttctgaagcctctgttctgttccattggtctatatatctgtcttggtaccagtaccatgctgttttggttactgtagctttgtagtatagtttgaagtcaggtagagtgatgcctccagtttttttttttttttttttgcttagggttgttttggctatacaagctcttttttgttccatataaaatgcaaagtagttttttctagttctgagaagaaagtcaatggtagcttgatttgaatagcattgaatctataaattactctaagcactgtggccattttcatgatattgattcttcctagccgtgagtatggaatgctttttcatttgtttgtgtcctctcttatttccttgagcagtggtttgtagttctccttgaagaaatccttcatgactgtttttaggagtattcctaggtattttattctctttgtagtgcttgtgaatgggagttcactcatgatttgactgtcagtttgtctattatcagtgtataagaatgcttgtgatttttgcccattgattttgtattcagagactttgctgaagttgcttatcagcttaaggagtttttgggctgagatgatggggttttccaaatatagaatcatgtcatctgcaaacagagacaacttgacgtcctctttttctatttcaatacactttatttctttctcttgcctgattgccctgggcagaacttccaatactatgttgaaaaggagtagtgagagagggcatccttgtcttgtgccagttttcaaagggagtgcttccagctttttcccattcagtatgatatgggctatggatttgtcataagttgcttttattattttgacatatgttccatcaatacctagtgaattgaaagtttttagcatgaaggcatgttgaattttatcaaaggccttttctgcatctattgagataatcatgtggtatttgtaattcgttctgtttatgtgatggattatgttcattgagttctgtatgttgaaccagccttgcatcctggggatgaagctggcctgattgtggtggataagctttttgatgtgtggttagattcagtttgccagtattttattgaatatttttgcatcgatgtccatcagggatattggcctgaaattttcttttttgttgtgtctctgccagtctttggtatcagcatgatgctggcctcataaagtgagttagggagaattccctctctttctgttgtttggaatagtttcacaaggaatggtaccagctcctctttgtacctctggtagaatttggctgcaaatctgtctggtcctgggcttgttttagttggtaggctattaattactgcctcaatttcagaacttgttattgttctattcagggatttgacttcttcctggtttagactggtgaggctgtatgtatccaggaatttatccacttctaggttttctagtttatttgtgttgagatgtttttatagtattttctgatggtagtttgtatttctgtgagatcagtggtgatatcctatttaacttttttcattgagtctatttgattattctctcttttcctttttattagcttggctagtggtctattttgttaaccttttctaaaaaccagctcctgcattcattgactttttttgaagggtgttttatgtctccatctctttcagttcagctctgatcttagttatttcttgtcttctgctagcttttgaatgtgtttgctcttgcttctccagttcttttaattgggatattagggtgtcaattttggatctttcctgctttctcttgtgggcatttagtgctataaatttccctctaaacactgctttagctgtgtctcagagatcctagtatgttgtctctttgttctcattggtttcaacaaactttgttatttctgccttaattttgttatttaacccagtagtcattcaggagcaggttattcagtttccatgtagttgaatggttttgagtgaatttcttaatcctgagttctaattgtattgcactgtggtctgagagactgtttgttatgatttccgttcttttgcgtttgctgaggagtgttttactcccagttatgtggttgattttagagtaagtgctatgtgctgtgagaagaatgtatatctgttgatttgggttggagagttctgtagatgtctattaggtctacttggtctagagatgagttcaaatcctgaataggcttgttaaatttctgtctcattgatctgtctaatactgatagtggaaagttaaagtctcccactattattatgtgggacctaagtctctttataggtctctaagaacttcttttatgaatctgggtgctcctgtattgggtgcatatatattagaatagttagctcttcttgtttcattggtccgtttaccattatgtagtggccttctttgtctcttttgatctttgttgttttaaagtctgttttatcagagactaggattgcaacccctgctgctttttgctttccatttgcttggcaaattttcctccatccctttatttgttttgagcctacgtgtgtctttgcatgtgacatgggtctccttaatataggacactgatggatcctgactctttatccaattttcccatctgtgtcttttaattggggcatttagcccatttacatttaaggttaatattgttatgtgtgaatttgatcctgtcatcatgatgctagctgtttatttttcacattagtttatgcagtttcttcatagagtcattagtctttatattttggtgtgtttttgcagtggctggtactgatttttcctttccatatttaagtcttccttcaggagctctggtaaggcaggcctggtggtgacaaaatcctcagcatttgcttgtctgtaaagattttatttctccttcacttatgaagcttagtttggctggatatgaaattccaggttaaaaattcttttctttaagaatgttgaatattggcccccactctcttctggtttgtagggtttctgccgagagatccactgttagtctgatgggcttccctttgtagataacctgtccgttctctctggctgccctacacattttttccttagtttcaaccttggagaatctgatgattatgtgtcttggggttcctcttctcgaggagtatgttagcgttgttttctatatttcctggatttgaatgttggcctgtcttgctaggttggggaagttctcctggataatatcctgaagagtgttttccaacttggttccattttccccatcacttttgggtaaaccaatcactgcttatttcattaagttgaccttcagtctctgatatcctttcttctgcttcatcaattcagctattgatacttctgtatgcttcacgaagttcttgtgctgtgtttttttttttttttttatatctccatcaggtcattaatgttcttctctaaactggttattctagttagcagctcctgtaaccttttatcaaggttcttagcttccatgcattgggttagaatatgagttcccctctagctgagaggagtttgttattatccatcttctgaagcctacttctgttaactcagcaaactccttctccatccagttttgtgcccttgctggagaggagttgcaatcatttggaggagaagaggcattctggtttttggatttttttttttttttttttgcatttttacgctagttttccttatcttcctagatgtatctacttttgatctttgaggctgatgaccattggatggggttttagtgtgggggtcttttatgttgatgttgatgttattactttctgtttgctagtttttcttccaacagtcagctccctcttctgcaggtctcctgcagtttggtggaggtccactccagaccctgtttgcctgggtatcaccagcagaggctgtggaacagcaaagattgctgcctgctccttcctatggaagccttgccccagaggggcactggcctgatgccagctggagctctcctgtatgaggtatctgtcaacccttgctgggagttctctcccagtcaagaggcatggggttcagggacccacttgaggaggcagtctgtcccttagcagagctcgaggactctgctgggagaatcctccttgtcaggatccactcttctgttcaaagctggcaggcaagaaggtttaaatccactgaagctttgcccacagttgctccttcccccaggtgctctgtcccagggagatgggagttttatctataagtccctgactggtgctgctgcctttctttcagagatgccctgccgagtggggaggaatttagaggcgtagtctggccacagctgctttgctgcgctgtggtgaattctgtccagtacaaatttcctggcctgcttagcactgtcaggggaaaactgcttactgaaacctcagtaatggcccctccccccagtaagctcggttgtcccaggttgacttcagattgctgtgctggcagcgaaaatttcaatctagtggttcctagcttgctgggcttcatgggagtgggacccactaagcgagaccacttggctccctggcttcagtcccctttgtaggggagtgaatggttctgtctcacttgggctccaggcacaaaacaaacaaacaaaacaacaacaacagcaacaaaaaactcctgtagctagcttggtgtctgcccaaacagctccccagtttggcgcttgcaacccagtgctctggcgatgtcagcacagaagggagtatcctgctccgtggattgcaaaaaccatggggaaagcataatatctgggctggatagcatagtccctcatggcttcccttggctgtgggaggaagatccctggcaatgcagaaacaccctgccttctgcattggtctcactgagagctgcagacaggagctgttcctattcaaccatcttgccagatctccatcttctcaaagttttactgtttctagtcttatgttgccatctttcatccattttgagttgatttttgtatatgataaaaaataagggttcacttttttcttttggttgtggacatccaattttctcagcaccattttttgaagaaactcatctttcttcattgagtatatttgggactcttattgaagatcagttagctgtatatattcatggatttatttctaggctttctagtttgttatgtagatctgtatctgttaatgtggtataatatacgtgttaatttttgtatgtgaaactatctttcattctaggaataaacttgccatgtcttctaggaaagaagtgatgctgagtctgaatacacagtaaaagccaagcaacactactggtcttgcaatctcaaaaggaagagtgagactttttacataatttaattattgaagatttcattggcaaaattaaaaacaaaaattctgctcaaaatgaagccaaaatattctgagtatttgcaaaacaatgttgatactatgagtggagttgttaatgttttgtgttcaaatacaatgtgtgaaacataaggaagctcagtaacttttgtgtggggtaacttttggattagaataataaatttcaatataagcccataaggttttatattattatttttcatagcttaaaaatcattgacatagaataattccaactaaagtacatattaaattcctggaaaataaattttgacttaacagggtaagttgtgaaaagacgttttgtcgcaggaaaaaggaaatcctccatttaaaaccctccatgctggaataaaggaggagtcccatcttttggtcattccacttcaggcttttgatataactaatcccttttcttcttctttcctgttttggcaagctttcggaaacaaaacaggcaacattttgtgatcataaatatcatagttgccacgcaggccagcaggaatgctatcacatccaaagagtggtactggatccaggtgaggttgtgggctgcgacccgaaggtgcttggctcctttatggcgcatgacaaactcaatccagaagactgctcgatccaggggcttcaccggttgatcatgatgaattcttgataatttcatgatattctctttatagctgaaggataaatataaagatatcaacattaaaagtaaatttattgcttaagcatatcaagtctatggatggtctttgaaaagcgccacacaagtgattcaaagtaagtgtcattgaattgacataaaatattaatgttttaatgtatgtcattacagaaagtttggtttttaaattggagttttatcactgacaaatacctttaaaaatgaaaaatggaattttcggtgggaaagttaatgtttttctagagcagaaaatattgtgagccattctaagtgctataagtaagatagtggaaatagaatctgggaatgatcattttgatatttttagttttttttttttttgagacaggcttttgctccattacacaggctgagtgcagtcacatgatcatggctcagtgcagcctttccgtttcggtctcaggtaatcctccacctcagcctcatgagaagctggggctacagctgcgcaccaccatgcctggctatattttttattttttacatttttagatatgaggtcttgctgtagtgcccatactcatctggaactcctgtggtctaatcattctgcctctgtctcccaaagtgttggccctacagacatgaaccactgtgcccagcccattttgacatatttaaagaagaattgtgtcacaactggtgaaatgtctcctaactagtttctcagcttctactctaatcttctgtcttctaccgtattttcctactagtagccagaacattttctaaattaatgtcaaattatgacagttgcctgtcaagatttccatctggtttcttgttacattaagaataaaatccaaatctgtctgtggtctagagaacgctacacagacacctacttgtcctaaccctttccccctgtacactttcttctagagacaatggccttctgttgttctttaaactcctgaaggtgttctcaccttagcccgtttacaccttttgttccccgtgtctctctcattgagcattctttcttgcaactacttgaggtttgcttctatttctttttgaggcttccccttaaatgatacctcttagagagtgttttcctggccacactataggcacccataggatttctctactgcttcgttcttattttgctatttgatttctggaactttaaaatatgttatatatcttccacaataaaagtttaagtatgaaatacataggataaatgtatatacgctatgtgactatctcaaaattttaagattatcttaaacattatccaaaagtgaaaacaccaatttatcacaaactgcatagaagaactctttcctcctgggccattttagtcactacttttatcctcaaagtaagtattaacctgaattctaatatcatagattatgtttatataattgaattaaataatacttattcatttctgtttttgtttagcagttgtttaattgcactggtgtagagtattcagttgattgacaaagaccacagatctcttcatttatgattaatggatatttgtgttgttaacattttttgatcttactaataattatggtattaagatatttatatattttattagatttacatacttattcatttttgttggatgtatacttggaagaatagttgatgagagaaaggcatatttataattagaattttttgactgaattttttaaaaaatattttttattttaaagaatcagagattgtttttagttatcattttctggatgatttataatttgattctagtatgactagaacatactatttttatgaatttgaatcttatacaatttacttagcatttttttatggcccagcatatggtcaattccagtaactatttcatacatataatctttttttttttttttttttgagacagagtctctctctgtcacccaggcttgagtatgacggagcgatcttggctgactgcaacttacgtctcctgggttcaagtgattctcatgcctcaacctcccaagtgtctgggactacaggtgctcatcccccacatctggctaagttttgtattactagtggacacaggatttcaccatgttggccaggctggtctcgaactcctgaccaaatgtgatcctcccaccttggcctcccaaagtgttggaattacaggtgtgagccaccacacccagtctccataaactcttttaaaaatgtttattttctgtctacacacacacaaccagagatatatgtatggatacatatatacagatatatgtgcaatatatatacacacacacacatataacacataggttacatttaattgtgtacttcaaatgttttatctccttaaataaaagttttcaaagatcattattttgtctactttggtctgtttaaatttaatgcgagtactggtaggttcacttttttgttgtgatctttgagatggagtctcgctctgtcaccaggctggagtgcagtggcactatctcagctcactgaaacctccgtctcccaggttcaagtgattctcctgcctcaaactcctgaggagctgggactacaggtgcacaccaccatgcctagctaatttttgtatttttagtagagacagggtttcactatgttggccaggagtatggtctcgatctcttgacctcgtgatctgccctcctcagccacccaaagtgctgggattacaggcttgagccaccacatctggtcggttcacattttttaaaaacagttttattttaagttccaggatacatacgcagaatgtgtgggtttgttacataggtatatgtgtgccatggtggtttgcagcacctatcaatctgtcatctagattttaagtccctcatgtattagctatttgtcctgatactctcactcccattccatgccccgaatggccccggtgtgttttgctcccctccctgagtccatgtattctcatttttcgactccctcttatgagtgagaacatgtggtgtttggttttctgttcctgtgttagtttgctgaggataatggctttgagtttcatccatgtccctgcaacagacataatctcattcctttttatggcacatagtatgccgccatactgtacatgcatcatattttctttatccagtctatcattgatgagtatttgtgttggttccatatctttgatattgtagatagtgctgcaatagacatacatgtgcatgtgtctttacagtagaatgatttatatgcctttgggtatatatcaagtaatgagattgctaggtcaaatggtgtttctggttctagatctttgaggaatcaccacattgttttccatgatggttgaactaacttacattcccaccaaaaatgtaaaagttttcctatatctccccagtttcaccagcatctgttgttttttgactttttaatcatctccattctgactggcatgagattgtatctcattgtggttttgatttgcatttctctaatgatcagtgatattgagcttttctcataagtgtgttggctgcataaatgtatttttttgagaagtgtctgtttatatcctttgcccactttttggtggtggtgttttttttcttgtaaatttgtttaagttacttgtagattctggatattggacctttgtcagagggatagattgcaaaaatgttccctcattctgtaggttgcctgtgccctctgatgatggtttattttgctgtgcagaagctctttagtttaatttgatcccatttgtcaactttggcttttattgtaattgcttttggtgtttgtgtcatgaaatttttgcccacgcctatgtcctgaatgatgttgcttaggttttcttccagggtttttatggttttgggttttacatttaagtctttaatccatcttgagttaatttttgtataaggtgtaaggcaggggtatagtttctgttttttgcatatggccagccagtttccccagcaccatttattaaatagggaatcctttcccattgcttgtttttgtcagttttgtcgaagatcagatggctgtagatgtgtggtgttatttctgaggcctctgttctgttccattggtctatatgtctgcttttgttccagtactatgctggtttggttactgtaaggtgtaaggaagggatccagttgcagttttctccatatggctaaccagtttttccaaaacaccatttattaaatagggaatccttcccctaattgcttgtttttgtcaggtttgtcaaagatcagatggttgtagatgtgtaatgttatttctgaggcgtatgttctgttccattggtcaatacatctttttggtaccagtaccattctgttttggttatgtagcctaatagtatagtttgacatcaggtagcgtgatgcctccagctttgttctttttgcttagggttgtcttggctatatgggctcttttttggttccatattaaatttaaagtagtttttttctagctctgtgaggaatgtcaatggtagtttgatgggaatagctttgaatatataaattactgtgggaagaagccaagatggccgaataagaacagctccagtctacagctcccagtgtgaatgacacagatgaggaatgatttctgcatttccaactgaggtactgggttcatctcccaggggactgtcagacagtgggtgcaggacagtgggtgcagcgcaccacgtgtgagccaaagcatggcgaggcattgcctcatcagggaagcacaaggggtctgtgaattcccttccctagccaaggataggggtaacagatggcacctggaaaattgggttactcccaccctaatactgcgcttttccaaaaggttttagcaaacggcacaccaggagattatatcgcgcacctggctcagagggtcctacgcccacggagcctcgctcattgctagcacagcagtctgagatcgaactgcaaggcagcagtgagactgggggaggggcgcctgccattcccatggattgaataggtaaacaaagcggcccagaagcttgaactgggtggagcccaccgcagctcaaggacgcctgcctgcctctgtagatccacctctgggggcagggcataaccaaacaaaaggcagcagaaacctctgcagtcttaaatgtccctgtctgacagctttgaaaagagtagtggttctcccagcacgcagcttgagatctgagaatggacagactgctactcaagtgggtcctgatccccgagtagcctgactgggaggcaccccccagtaggggcagactgacacctcacacagccgggtactcctctgagaaaacttccagaggaacaatcagacagcaacatttgctgttcactaatatccactgttctgcagtgtccgctgctgatacccaggcaaacaggatctgcagtggacctccagcaaactcgaacagacctgcagctgagggtcctgactgttagaaggaaaactaacaaacggaaaggacatccacaccaaaacccatttctacatcgccatcatcaaaaaccaaaggtagataaaaccacaaagatgggggaaaaaagagcagaaaaactggaaattataaaatcagaatgcctctcctcctccaaagaaatgcagctcctcaccagcaatggaacaaagctggatggagaatgactttgacgagttcagagaagaaggcttcagacgatcaaactactccggactaaaggaggaagttcgaaccgaaggcaaagaaggtaaaaaccttgaaaaaagattagatgaatggctaactagataaccaatgcagagaagtccttaaaggacctgatggagctgaaaaccatggcacgagaactatgtgatgaatgcacaagcctcagtagctgatttgatcaactggaagaaacggtatcagtgatggaagatgaaatgaatgaaatgaagcaagaagagaagtttagacaaaaaagaataaaaagaaatgaacaaagcctccaagaaatatgggactatgtgaaaagaccaaatctacatctgattggtgtacctgaaagtgacggggagaatggaaacaagttggaaaacactctgcaggttatcatccaggagagcttccccaatctagcaaggcaggctgacattcaaattcaagacatacagagaatgccataaagatactcctcaagaagagcaactccaagacacataattgttagattcaccaaagttgaaatgaaggaaaaaatgttaagtgcagcaagagagaaaggtcaggttacccacaaagggaagcccatcagactaacagctgatctcttggcagaaactctacaagccagaagagagtgggggccaatattcaacattcttaaagaaaagaatcttcaacccagaatttcatatccagccaaactaagcttcataagtgaaggagaaataaaataaaatctctaagcatttacagacaagcaaatgctgagagattttgtcaccaccaggcctgccctaaaagagctcctgaaggaagcactaaacatggaaaggaacaactggtaccagccactgcaaaaacatgccaaatgataaagaccactgaggctaggaaaaaacggcatcaactatcgagcaaaacaatcagctaacatcataatgacaggatcaaatttacacataacaatattaaccttaaatgtaaatgggttaaatgctagaattaaaagacacagactggcaaactggatcaagagtcaagacccatcactgtgctgtattcaggaaacccatctcatgtgcagagacacacataggctcaaaataaagggatggaggaagatctaccaagcaaatggaaagcaaaaaaaggcagggattacaatcctagtctctgataaaacagactttaaaccagcaaagatcaaaagagacaaggccattacataatggtaaagggatcaattcaacaagaagagctaactatcctaaatatacatgcacccagattcataaagcaagtccttagatacctacaaagagacttagactcccacacaataataatgggacactttaacaaaccaccgtcaacattagacagatcaacgagaaaaagttaacaaggatatccaagaattgaactcagctctgcacgaagaggacctaatagacatctacagaactctgcaccccaaatcaacagaatgtacattcttttcagcaccacaccacaccaactccaaaactgaccacatagttggaagtaaagcactcctcagcaaatgtaaaagaacagaaattataacaaactatctctcagaccacagtgcaatcaaactagaactcaggattaagaaactcactcaaaactgttcaactacatggaaactgaacaacctgcttctgaatgactactgggtacataatgaaatgaaggcagaattaaagatgttctttgaaaccaacgagaacaaagacacaacataccagaatctctgggacgcattcaaagcagtgtgtagatggaaatttatagcactaaatgcccacaagagaaagcaggaaacatctaaaattgacaccctaacgtcacaattaaaagaactagagaagcaagagcaaacacattcaaaagctagcagaaggcaagaaataactaaaatcagagcagaactgaaggaaatagagacacaaaaaactcttcaaaaaatcaatgaatccaagagctggttttttgaaaaggccaacaaaattgatagactgctagcaagactaataaagaagaaaagagagacgaatcaaatagatggaataaaaatgattaagggggtatcaccaccgattccagagaaatacaaactaccatcagagaatactataaacacctctacgcaaataaactagaaaatcaagaagaaatggataaattcctcgacacacacaccctcccaagactaaaccaggaagaagttgaatctctgaatagactaataacaggctctgaaattgaggcaataattaatagcttaccaaccaaaaaaagtccaggaccagatggattcacagctgaattctaccagaggtacaaggaggagctggtacccttccttctgaaactattccaatcaacagaaaaagagggaatcctccctaactcattttatgaggccaacatcatcctgataccaaagcctggcagggacacaagaaaaaaaagagaattgtagaccaatatccctgatgaacatcgatgcaaaaatcctcaataaaatactggcaaactgaatccagcagcacatcaaaaagcttatccaccttgaccaagtgggcttcatccctgggatgcaaggctagttcaacgtacacaaatcaatgaatgtaatccagcacataaacagaaccaatgacaaaaaccacatgattatctcaatagatgcagaaaagacctttgacaaaattcaacaacacttcatgctaaaaactctcaataaattaggtattgatggggagtatctccaaataataagagttatctatgacaaacccacagcaaatatcatgttgaatgggcaaaaggtggaagcattccctttgaagactggtacaagacagggatgccctctctcaccactcctattcaacacagtgttggatgttctggccaggagaataaggcaggataaggaaatacagggtattcaattaggaaaagaggaagtcaaattgtccctgtttgcagaagacatgattgtatatctagaaaacctgatcgtctgagccccaaatctccttaagctgataagcaacttcagcaaagtctcaggataaaaaatcaatgtgcaaaaatcacaagcattcttatacacccataacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggaaacaaaccaatggaagaacgttccatgctcatgggtaggaagaatcaatatcgtgaaaacggccatactgcccaaggtaatttatagatccaatgccatccccatcaagctaccaatgactttcttcacagaattggaaaaaactacttgaattcatatggaaccaaaaaagagcccgcatcaccaagtcaatcctaagccaaaagaacaaagctggaggcatcacactacctgacttcaaactatactacaaggctacagtaaccaaaacagcatggtactggtaccaaaacagagatatagaccaatggaacagaacagagccctcagaaataatgccacacatctacaactatctgatctttgacaaaccttacaaaaacaagaaatggggaaaggattccctatttaataaatggtgctaggaaaactggctagccatatgtagaaagctgaaactggataccttccttacaccttatacaaaaattaattgaagatggattaaagacttacatgttagacctaaaaccataaaaactctagaagaaaacctaggcaataccattcaggacataggcatgggcaaggacttcatgactaaaacaccaaaagcaatggcaacaaaagccaaaattgacaaatgggatctcattaaactaaagagcttctgcacagcaaaggaaactaccatcagattgaacaggcaacctacagaatgggagaacatttttgcaatctactcatctgacaaagggctaatatccagaatctacaatgaactcaaacaaatttacaagaaaaaaacaaacaacctcatcagcttgtgggtgaaggaaatgaacagacacttctcaaaagaagacatttaggcagccaaaagacatatgaaaaaatgctcatcatcgctggccatcagagaaatgcaaatcaaaaccacaatgagataccatctcaccccagttagaatggcaatcattaaaaagtcaggaaaccacaggtgctggagaggatatggagaaataggaacacttttacactgttggtgggactgtaaactagttcaaccattgtggaagtcagtgtggcgattcctcagggatctagaactagaaatatcatttatctagcattcccattactgggtatatacccaaagggttataaatcatgcttctataaagacatgtgcacaagtatgtttatggaggcactattcacaatagcaaagacttggaaccaacccaaatgtccaacaatgatagactggattaagaaaatgtggcacacatacactatagaatactatgcagccataaaaaatgatgagttcatgtcctttgcagggacatggatgaagctggaaaccatcattcccagcaaactatcgcaaggacaaaaaaccaaacaccgcatgttctcactcataggtgggaattgaacaatgagaacacgaggacacaggaaggggaatatcacacaccggggcctgcttgggggtagcgggagtggggagggatagcattaggagatacacttaatgttaaatgacgagttaatgggtgcagcacaccaacatggcacatgtatacatatgtagcaaagctgcaccttgtgcacagataccctaaaacttaaagtataataaaaaaaattactttgggcagcatggccatttttacaattctgatttttttatccatgaggatggaatgtttttccatttgtttgtgtcctctcttaattccttcagcagggttttctatttctccttgaagaggtccttcacgtaccttgttaggcatattcctaggtattttattctctttgttgcaattgcaaatgggaatttattcgtgatttggctctgcttgtgtattgttggtgtataggaatacttgtaatttttgcatattgatttttctatccggaggctttgctgaagttgcttatcagcttaaggaattttagaactgagatgaaggggttttctaaatatagaattatgtcatctgcaaatagagacaatttaacttcttctctttctatttatagaataccctttatttctttttcttgcctgattgccctagttcacatttaaatccaccattttattctatatatttttgttttctaacctgttttctgtttctttgcttttttactttatttgaagtattttaaatcatttcttgtcttactaattttttggtaaagtgtttttaatgtattctcttagctggtaccaccttacatcataataatattggtaggattaatagactctgaattgatggtagctggtgtagtcacagcattttccatattatttcccttggattatggaaaactattacatatttattttatcaatattaaaaccttcatgtttcaaaaggcatcctccaaaaagtaaaaaaaaaaaaaaatctatctgcccatagtggaagaaaatatatgaaaatcgtatatttgataagggatagtatctataacatattaataattcttatgaatccataataaggtaaatagaaaaatgacaaaatgttcacaagattaaaatagaaattttatctaaggaagatgcatgaatgatcagtaagcacatgaaaagagggttaacatcttcagccataaggaaatgcaaatgaaaaccataatgagagaccactttacacacactagaaaggctgtaatagaaagacaggtgataacaagtgttgggaagagtgtgaagaaattagagccctcctatccagctggtggtaatgaaaaatgatgcaaatactttgaaaaacagtttagccattcttcataaacaacaatttcccatatgcctcagcaagtccactcctagcctctcctcaaaagaagtaaaaacatatttttacacagaaaatatgtataacaatattcgtaagtgccaaaattggaaagacctaaaatgtccatgccctgataaatgggtaattttggtataaacatatcaaagaatattatatagaaataaaaatgaatgagttctgatacatccaacaacataaataaaactaaaaataattatgctaagtgaaagaagtcgtttacaaaacactataaattgtatgatttcatttatataaaatatgtgaagagaataatctattgagaaacaaagtaagtcggtatttttctaggactggaggtgtattgggagtgacttcatgcattttgagtttaatttgagctcacaaaaatgttatttagggttgtggcttcgtaactatgtaaacatactaaatatatttagattttaaattttagtgaatgttatgctatgcaaattgtaactcattttcaaattgattaaaataatgataataataaaaataaatttttgagaaagaatagattcatactttcagaaattttaggtattgaattgaaatattttatcatatttctctagttacataatttctattgtgtattctatcattaaaaatatttaaaataattatgtacatatctttaatttttttgattttataattcattgcagtcattggtgacccattaaatctgtggggttgaaatgtaactttgaaataattgtctggtggaaaataagagcagattttacattggttaaatcacttcaatcccttcaaaattagtctcttaacaaagggttcaaactcatattcactgttgacaaaataatttgtaagtaccacctggtcacaaaattgtaatactcacatagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagattgcctcatagatgccattggttccaccatgagttataaaagctttggttttgggatgacctaaaagtggatgcattttaacaaagttattaattataaggcacaggaattgaataagaaatgcacaatataaggaacttaaagcaaaactgttccctaggtaacattatacccacaaaactgcattgaaattgttttcaaatttcagaggaagaagcacctacttctgctggaaaggtaagtgaaggctacatgaaaaggtggtggtctgtgtgtcttcacagtggaaacataaatttaaaagtttgccaggtgaacaaaatgaaaaaacatattcttaattaaaaaattaaaatgtgcaaaaaagaaaagaataagatttggtatacaagaacatagtctcttaagtagtataaattatgcagtcacatttatatatttaaaaaatatttaaatagttaaaatatttaaaatacttaaatttttttttaaaggcagcaaggagtagggtggaggtggtgctgaggaaggacaggttacacatcatcatgaaatgtgttatcactttatgataaagattggtgatttattcccacagaaaatagagtcactggtaatagaagaatgtctgttatttttcagtacctgttgaaataaccctgcagtaggggaaggaacagatgtaaagttgcagaaataagagacagaaaatccaggatgttatttaaaacctgtgagaggtaattacacctgaataaagagatttttattctgaccataaagaatgtgactgtatgtaacaaaatgccaactaccatagtgtattcttcttatactaagactagaaaataaatataaagtagttaaatttgatttttttttagttttccaataataaatgttaaatatgtttgttttatgttgaaatattatcacttctaattggctgttactaatatattcagtatttgttctccagagtcttaccaagaaggtcattctggggtaaccacttatacagtcgagtattggaacctaaagtatttggcttcttgccatcaaatctccatagaacctgttagggcaaggaaaatatcttgttcaatgaatagaactctaaaaatataacttgttagaattctgaagagattaataatcagttaatccatataaaagatgaagaaataagaagaagtgatgtcaagtaatgagaactactaaaagtctgaggtaagctgaatacccacatttaatatctttacttttataatcaatttggtatataaaaaaatgacatttctaacttaatagctagacacatgagagtgtgagaggaaaataaatcttggtgccccaaaatctatgctaaagggaaaagttaagctgctcagggcaaacctacttcccattctattcaaagtcagcccttggctcactgagataaatgcatatctaattgcctcatttggagaggctaatcagaaactcaaaggaattcagccatttgtctcctatctacctatgacctggaagccccttccatgcttcaagttgctctgcctttgtttctagttgtcccccatttctggactgaacaaatgtccatcttatataagttgattgatgtctcatgtatccctaaaatgtataaaaccaaactgtccccccaccaccttgggacacatgtcaccaggaccccctgaggctgtgtcatgggtgcacattttcaaccttggcaaaataaactttctaaattaactgagacctgcctcagatattcagggttcacattttggtaaccatgaagagactctgagtggaggttccctgacctttgataaatgtcctgtcagtgcttggtaccagcatgagctaactttatggctcaaacaaataagacaattggctgaggtctgggagcaacccctccagagaatccctgataccccaaaattcagtcaagaccaaaagtttattttgctgtacaactcctttttttttgttttttatttttttttggagttttacttgcttcctacaagaaaggcaatatttcctgtttccatgacaatggaaggcaggtaactctatggagtttgagctcactcccaggagggaggataaatttgaggtttctttcctacttctaggacgacagagggcagttttagcctgaaacccatccgtaggtaaatagctgaattggggttttgtcttggttaatgtttaacaactagctggacttaatttctccttaccattacagtgcttaatgatcacatttttgggagtattttttttgtacattccagtatttctcccatcagatttgacaaactttacctgacttgatcatatctgagtgagaattccaaattgtgggtaacaaagcctgtctaatttggtgaaaattcttcacagatgcaaaagagaaaacaaaacaaaacctaaaaaccatgctcttggtttctgtgtttgcttcctgtctttaaaaaaacaaatgttcttttgtttacttttcctccaccctatacctccttttgtcttttgccatttgtagtaccaaaaatctagagaaggcttctaatgatttgaactcttttaaagaattcagaacaaaggcaccactcacccctttgggggtgctctgttttctttgtggagtttcaagagttgtgggcagattttttcttaggtccaaagctctgttttcctatgttgaatgacctgatctctttggcttcgagattaccacagattaccttgtactgtgagaggattttaccttggcgtgtgtaatggcagacgagttacaaagtagagggtggctgagtacagtttactggaagtagtattgactgttgttatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgaaagactgagttttctcagctccaaagtgaaagggcatctgctcctcccaggcaaaaggcacccctaagcaactgggggccttgtgggagtgtcttgggtttgaccccctatgacatgcagtggtcctgcagggaaatccccaagaaaaattaacttttaaaaaaaggctagtccaggaaacacatatgagggcagatcacccagcattttgagccctctcagaggtcatacacctctggagggagaaactgagacacgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaagaagaagaatgatcccctgatatcgcctgtttggatttatgacacctctacttggcagagtttatgtaaaatgaaggtaatacggtctttgtgcacatatacattaagagccctaaggttgtcctacaaactgtagagttcctaagttctctcttttttaaaaattttcttttattcttgctttaaatttgcttttatttttctattaagttaaaaaccactgttttgattcaacaggtttttgtctgcaagctggtgatttttttttatctcatagctaaatttctgaagtaaaaaccacataatcttttgtgtgtgtgtaagtgtttgcatatatttaaaaggccattataatttctataattttatgtttaattggcaattaaatccattttattttccttctagcacaccaatttttttctctgtgtacattatgatgtaaattttgctatttgattttcacctgaatggtttcttttaatatgcaaatgtaagattatttagctcacaactgcctatggtgatcaagtattcatacagattacctattgaaacaggttatcaagaatttgaaagtctaatatggcaaagaggagtttttataaacctgtaagatgtacttctgttggcatgcttactacatctatgtatttatgtgttttgtacacaatgttttattactgaaaatatataaaagagctctaattaattggcttaagaaaataaaagtgcttgaattaaatactttgccagaaaaaaagactaattaaatgctttttcaagtttatgtaacttaaataaaatcttttataaataagataacaacaattattgataaagtatgataatattagaaatgcattaagacttgccagcatacatttttgtttgcatttattaatcaagaaatttcatacttattcttgccaaatactttaaggtgtcaaaatttgacataggggttacaaaactgtaaaccaagcccaaaacagaatgatcttcacttgtgtaatttttaataaataagacattaatattggtttaatgcaaatagctacaccttgaattaagtaagattatcataacttctcatcttgtggccttaagcaatctagtccacaggcattaagctttgttttgggaaaagactgttatcatttttatttcaaagctaaactataaactaagttcctccttaagttagtttggcctacacccagaaataaacacggagagcttggaggttaaaagcaagatggagttaggtcagatctttttcactgtctcagttataattttgcaatggcaattccataactttaaatgatgactaccacacttttcacaaatattctaggtaaatgactaaataattaggtaaatgtaatgggataaatacttatagacaaactcataatttagaatctaaggttatattaaattaaataatagatatttcattgtttgggtatttttaaaaaaaaatttgtaggaaaacattctttccaaaaaaaagtgcatcttttttaaaaaggtgaagaagtgttgtctaattcaaagcttatttaaaggttatgtataaaacaaggtaaaaggaaccaggaagtaagggagatgtaaagaaagttataaaaataaaaagttttttttttttttttttgtaaaaagcttgaagagaaataattttatatgagaaagaatcttgtgtggtaaatttagtcctagaataaaatgatcagttgtgtaagaaagaaggatgttcaggacaaaccagaaagtccaaacatatcatgaatgatctgtgtaagtcacaataagaagattaaaaaaacttttatatgatcaagttgtctataattaaagggaaattataatggtgtttctacagattgggcttgatgtaaaaaaagcacttatgcactaaataattggttagaacaataacattttcttaagggattgatttactcttaaaatattatgagttttttttttttaacccaaagtttaacttttcttgcatctcactgtttttggttttctctccccttttaaagggtgtgaaatagtaacactctccttcaactcattttcaactcatgtaagttttttcctcaagttctgtttgttgtggcataatgctaacagtgttttctaaaagctattcaactcctcaaggtccagggactatcacagaagaggtgggtgtgtgagattgaaagaactgatactaagagataaaataagttccgtttatgcataaattaatcattaatgtcaaagacacactaatgcaagaccaacatatgggcccctgtgtcagattaacaaggttttcttgaagcataaactgacttcttaataaagattataaacgttatgaaaggctgaggaaagttatatcttatggtcaagattagaattttatagattgttcatacaattttgaaaaacaaacttatttggcttcatgctgttttattagggcttattgtttggcaaattgagtctcctctctcaaagaatgaagatttttgcctttttttgaaatccttgagttactactttagtcaaatgaatgctttattttacctgtgatatcaagctttttaatcctttgatatttgacaaattttccaaaattatgtttttttctgacctaagtaatcctttaatttattagtttccctaaagtccaaaaatgacataatttggcttatttggtataaaaattatacagggaacattgtcaaacatgaaatggtgtttggtctttttgagctgtatttatataaatatgttattggcatgtgttccaaaattatgggaaactcctataattctgatatgacttagtgtgtacattatcagtaataattatatttgttatgttaagttattgtgtgccacagaggtaacaaatttccttgtccattgtgtctttgactgaggctgccctaaaactttttgtcatccacagacaattgttgtctgactttggtcctctttagaaggcgattttatactcagccatgaaattctaacaggtgctcttgaaaaaaagtttttgataattttggagattgtgacattagaatggaagaaaaactttcaggactcatggagaactaaaatgttcatgaatatcaagcagaacaggaattaactacatggactgaaataatagaaaactaaagtaatctttttgactttgcttaaaacattgctgatcctttgttttgttttgtttttttttttagagtgaaggaatctttctttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggaatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcataggtatttgatggtacaaatctatggcttgcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaatttttattactgtctacagtttggactgaattctaatttttcatggctacacgtcttcaaaatagtgtcttcaggttttttttcctccccttccacaatttttcctaatttggagtcactgtaaactaagctatgctttcataaagccctacaaattaagctagacaacttaaactccagaagaaaataacagcaaccaatttacatacataatccactttcatacctgcctactgatttatggacttcagagtaatgtggcctatattaattttaaaggattgttcttttgtttttgtttttctcacttcctccctttattttgtcttcacagtacatgagacttcagaacctgctaaaaatgaactttcctaataactcaggacctgcttaggaataaaccttccttgccattagagatcagatgaaaacctgagaccagagactcattttcttctaaaatgctttctccaaaagatttttttaaaatgtaaaatgaaaataaacctgggggccccaaagtcactaagcaaatcactgcctcccattctattcaaagacacccctctgctcactgagataaatgcatatctgattgcctcctttggagagcctaatcagaagctcaaaggaatgcctcttccctgcttcaagttggcaaaataaactttctaaatgtactgagacctgtatcagatatttggggttcacaagattatcaatgaaatattcaaatatataagaattgttaggcagtcttaattctagtaataaaaaagtagcaaattagtaataacctatatatttattttatatactttatactagctgtaaccttccaaatttaatataaatttattaatttttgagtgatatgggaagagtttacttatatccacttgtctactagtcataagttattttatgaatttgacatcattgattacaaaagactaaatacttaaactgcacatatggtgagaaataatgctacatatgtagtaaattcagactattatcagtattgctacttttgtaaatgctaacaatgtaggaaaaaggagcccattgacaattcatgattaacaatacagatgctgagaatgtagaaaattgtattttgctactttttgcttaactgatctttcacacttagatgatgcactacctagcattgacagccttgatatatggtcagctatagccagtcattaccatgtctagtaccaaactaaggtactgattttagatttcccaagcaatctttataaactggagtagaatttacaagtgttgtccttgtatttgatatgggagtgttaaagtaactctgtgttttcagcaaaaacttgcatagatcattcagagagggctatgcagataagaaagtaaaacgtaaattgaaaatacacaaagattgtaggtatattctatagattagaaaataagttcctaccatgtttatttatagttcctgctccttcctcaatgtggagaaggcactaatctgattcttagagcatagtctttgttgggccacatttaataatgcacatagtctaccctaaaagcaggattctatctccatcctttccattacatttttctgcttaagacattagcggcacccaagccagcagagcagacaagtttttctttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaattttaccgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactgttgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaagaaatgaaacaaagctatgacactgcagtaggaggagataatgctagaaaatattacacccagacactttatttataatattataattactaacataggttattggaaggtagctttacttggctttaattctatttttttttgtagttctactaaatctcttgtgtttatttggggtcattttattttatttttttctgttcagttcttttagttaggagtcattggagccattacatgactatgagcaatgaggaaaagttagttacaattagaatgattttatatctacatttatttagcttctttagctctctaaccctttatatttcacttagagtttcctagtcttaccccactacccctcacttcccccgacacccccacccccaaaaaacaccttaaaagctgaagtataagaatcattgacgttcatcagtctggtgttggggcttggaatttccgggaaatagttctgagaattccatttataatacagtattatatactatttagttacataattaagtgatcttatttctcagatcattgtttaggtatgactatgataccttttgtcctgaaatcacactgtgaaattgatgtgctatttataacttaccatgagggaccctcatcctcactttgctgtgtctcacagggggcacttgaaccacagtgggagaggtcaccaagcctttctccagtggagatctgctcaccccctagagtagctccctcacactatatgaagctcctggtaaatatgtgtttgcttcgaaatgaatgagaattattctgacttgtgtttcctgatgtgttcctgtttttaaacttaaatccattctctaatgccacatcagtcaatgtattctcacaccaaaaaaaaaaaaaaagaaaaagaaagagagaaagaggaaaagaaatgtagactcataagtttcccggatatcatatcaaaattgtatactcatctttttgttgctattgtcccttttgttctaaattctttttttctcagtaaaataatgaccaaccccttctatcataacaaatatactttctggtcctaatcattgggggaaatttctttataaaactgtttacgaataaaaaaggaaattctaaaatatgtcaattcagaccatatattggtatttttcaaaaatataattgaactttatgacatcttttatttttattttattttatttatttatttatttttgagatggagtcttgctctgtcacctaggctggagtgcaatgatgcaatcttggctcattgcgacctctgcctcccaggttcaagcaattctcctgcctcagcctcctgagtagctgggattacaggcacctgccaccacgcctggctaatttttctgtttttagtagagacaggtttcaccatcttggccagactggtcttgacctcctgacctcatgatccacctgcctcggcctcccaaagtggtgggattacaggcttgagccactgtgcccggtctgatatcagttttaattggagattcagtgtatggctattagagttaattcatgaggcatccaggaactcagtgtaattgcagttgcctgtagccacatttaatgtaacttcggtttaatgttttgtctcattcactgacaaaagtcttcttcatccaccaagtattgaagtaaaaaatcgtctgtttatagacagatcagcactgatctcattctgtgacgtctttatgaaagcaatggtaatagaagatcaatgtaagtagtcttgtaaaagtatgaaaatttaggaaaaaaatcatttttcccatatctctatctcaatttaaaatgtgtaccatttcattatggttttaattctatttatataactcaatgtacatatgtgatgtttatttagaaaattttttctcattgtatatgcctttttatcctacaaaaaaattgtgatcttgttctactcatcattctgttccttagtttccaactatacctgtactacagctgacagtgtaattaaacattgttttgaaaaaatggattgtaatggcttggtatgcgcattgtataagtttttaaccatttcttaatgtaagatatttgaattatttccagagttttttaacgaatatttgctactaatattgaatcttaccatcatgatttattctctgtacagtttcatgtgaatatattacaaaggcaataactatatgcagttttcaaacacttgatactttttggcaagagtcttattcttttgaaatatacaaacattatctgagaatctaatacataatggaaaagcaagcaaatttgtggcaacaattattttgtgtacaaaagaattagagaatcggtttcacaattatttacttagattcaagtctaccttttgcaggttaacaacaacagccagtgccgggcacggaggctcacacttgtaatcccagcactttggaaggttgaggcaagtggatcacctgaggtcaggagttcgagaccagcctggccaacatggcgaaactctgtctctactaaaaatacaaaaattatccggatgtgttggtgggtgcctgtaatcccagctacttgggagtctgaggcaggagaatcagaatcacttgaacctagagggtggaggttgcagtgagctgagatcatggtagtattagtaataatcactattgtactactagtcatttattccttgtcctccttattctcctattctcttccccctgctaatggcactatcactttcttttgatgtgagtgaggatttttttttgagaataagataagagtacacagaattaccttttaagctaaaatattaatgaagtgcctccacctttgcaatacaactttagctttccagcgtgttcaactgactgcccaaacttaaacatttatatttaaacaagcacacagagtatctgttctctaggattttgctaggaaaatcaatcattattaaatgaagactgatatcttaaatggctggcacatgttagctaatttaaaatattagaaataatgactaaaataataatcataatatcaacaatatttttggatcactggctatgtgtcagagacaacttaagtgttttatctgtggtaactacttttttccacacaacacaatatgaagttgtgattattattgtaaaagtagtcatgattgcctaaactcatgtaaaagttcctaaatattctttacattgtacaaagttgcctttctgtaatattacacattgagaacattgggattttttttgaaaggaaatctgatcatatctcttcatttcttaactcttttcagtagctctccattgtccttaatgggtatatcaaatttcatatatatatatatatatatattttttttttttgagacagagtctcactctgttgcccaggctgttgtgcaatagcatgatctcggctctctgcaacctctgcctcccgcgttcaagcgattctcctgcctcagcttcccgagtagctgctattagaggtgcctgccaacatgcctgactaatttttgtatttttagtagagacggggtttcaccatgctggccagtctggtctcaaactcctgacctcaggcgatccgcctgcctcggcctcccaaagtgctgggattacaggtgtaagccaccacgcccggcccatcattgacttttactcaaccttttcctgtaaactaaatttggagtcctgggaactgcccttactgcttttctacttttctgccttaatgcaagactttacttttttgtttgtttatttgtttgtttttgagacagagtctcactccgtcgcacaggctagagttcagtggtgtggtctcagctcactgcagcctctgcccccagactcaagcaagcctcctgcctcagcctcttaagtagctgggactatgagactacaggcacacaccagcatgcctggctattatttttatttttgttagagatgaggttttaccatgttgcccaggctggtctcaaactcctgagcccaagcaatcgtcccttctctgcctcccaaaattcagggattataggtgtgagccaccttgcctggcctctggttttctttttgggtctttctcatcccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgttaggcatgagggcgcagaaactgtgctacctttattctctgaaaatccagcacttacctgtggtttgcattaatcactctacaaatattttttgaagaaatgaaccatactatcttgtgggttgcacaatgaaggccttactttaaccaaccctgttttcaaaatctccctagtaaacctctttggtctttaatgataataacattcacatacttgtgatagtatagaaatatatgattttctaatggcaagtccttttttttgacctcccatattcccctcactctgagttaaacactctgaaagaaacatatccagccattccttctgaaaatgtcaagcaaacaaatgaaacaagaatatgttcaccttaggcaagggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttattttaatattgaatatgcaggtattttcctgaaaggacttggaataacatacctaaaaatatataaaatgtctgcacattgataatatatataaatacatttatataatataatacattatattaaatacattatattaaattaatgtatattaaataatattaaatacattatattaaattaatgtatttaatatatgttaatatattttaatttaatagtatttaatttttaatttttaatatttaataaagtttaatatttaatattaataaaattttattaattttattttattaataaaacattaataaagttaataaaattaaacaatatttaatatttaatttaatatttaatatttaatagttttaatttaatatttaaattatttaataaaataatttaatataatgtaaatacattatattaaatacatttatatagtcatcatttaatttttatgtattgcatatgttgctcatatgtatatataaggaaggcaaagtgttcagagagctgtaagaagaaatcacatctttaatgtaacatcagtatattcacaatcataaataattattaaaataagtcactaatatggtttgactgtccccacccaaatctcctctcatcttgaattataatccccataatccccatgtgtcgagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattgcccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaaatttttcagaatttattgacatagagatatgtgctcttccttattttggcccctattttctttgatggagagatgcagtttaataaaatatagattaaaacttagatgttcactttcaacaagatttcagtttttgaaggaaataattgtgaagttgttattgaaggaatgtataaatattagaaatctcaagttttaggcttctgtttctggagtagagccactatatttctcaactgtgaaggaatccttcttatatgaaaaacaaaatttaatttctaaatgaggaaactgaggtactcaggtacaagttcctcaatcctgcattgataatatttttagaaatatgtgtaaatataaaatttgtatgtctgccttcatgaagatgtttcttgaagtatctattgacttttttaaagatgaaaaaatgtatagcaaaatgatatgtgatggcttaaagaaatcataagtgttttacattgaaggtttatgactctcttggtgtcctatagcagtgatggcaccagggttctaactgattctataaggtcaacattctatatttttgagactcatagatcatcttacatttgcaattcataatttcccataaaaacactatcttctgacattatatttatataagcccaccttcaaaggcacaggaaaattagaacttaataaacaccaattggacacacgacttacctagaacttcactataaaactggtcccacttcttcagatcatatgcttgaaaccaaaagtcaaaataaagcatatatatcatattttttatcctctccatgaaaatcatttgatcacttaattctgacataacaacaggtacataggaaggagggaacagaaatcctccaccattcttctcaactgtgtagccaacagagaagcggagactgtacagaaagggtatgttaagtagctcagccagcagctcaccacagggattaacggcatctgccagaaggacatcaaattttgactcttgtagttttctcataagtttcttgttcaaaactgcatcttcacagagctttatattatagtcagaatattcccaacacaattcttgtagttgtgaaaaatatgaccaaaatgtattttttgaaatactatatgtccatctatcgaacattttcataaaaaaatcttccaaatcatttttagttaaagatgtaggataaacttctaatttaatagcagatgatttactggcattgacaagaatagaagccgaagatgtcaacacaatcacctcatgacccctctgaacaagctcttccaggattgtcttcatatttatccaatggctgtattctgtgggccacaccagcacctttccacaactcccagagctaaagtaacaactgagctgcatcagcagaaagactgacatccatttcagagacatcctggtcttatgcagtgcttcttttccagttgttgtttctttctgtcatttctcatacttatatctgaggaaaaatcaatcaagttaaaatataactgctaaaatttgagttgacctcatatttattttagtgtgtttggtgttcttttatatttacaattactctagtcaagcaataatttttatgacctagaatacgtaagtaacctgtcttatgtaattattttataatactgttaagaacagtggcaggtgagaggctcctgcctgttcggtgcccttgacatagagagaagaagtaattatacaactcaaacgccattttttaatatcgtggtgcaagtaatgtcttctaaaactttgttgacacataattcatataccatatgactcaccaattagtgtgtacagttcaatgtttcctagtatattcacagaattttactttcactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcaggtcaactgcaaggacagaccagcaattctgagaggatccacacaccctctgcaggaagcgtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatataggggtagaggaagtagcagaaaggtactgggagctctctggatacccaagcagctcattcctgcctggcaccacagtgatcctttaggagggtggccagcggagcagggggttcaaagattcttctggggcctgaaagcttgaagggatgagtaactcctcccttctcaggcccagtcccaagatgcaaggctgcttgcatcagcagcgtgtgtcagcaagatagcagaagcaggaagagagccggccagaagacacctaccctggctggagacatgaacccttgaagatcaagaggccatccagatactacatagcagtcacgttagattgggacacttactctttacagagaactataaaaccactgtcccatcctcacttggggctgatgccattttaggcctcagcccacctgcacccaggcactcattaaaacagcacgctgctccgcactgcctcgtgttgtctgttggcatgctctcagggatcaaaccaattcaagaaccttatatctggtgccaaaacctgggtggggctcaggtctgtgtcccttgtggacctacccctccaccccagagagcaagccacagcaaccagacaaaggaaactcctcagcctccagttgcctctctgtgcatgtgtagcaggatgagccacagacaaaacttctcagacaccaagttgtagaaggaagggctttattcagctgggagcatcggcaagctactgccttaaaatccaagctcctcaagtgcgcaatttttgtcctttttaagggctcacaacactaaagatttcacatgaaatggtcgtgattgatttaagcaagcagtgggtatgtgacaggtgctgcatgcactgctggtcagagagaaacagaacagggcagggggttttacagtgttcttctgtacaatgtctggaatctctgaataacatcggtttctaagttatgagttgatttttaactactgggtttaggtcaggcaggcccaggcctggtttcaggcctggagccaggctgcctgtctttggttttacttctttgttgttttttcttaaaacaggtactgagcataaaacaatataaaataatctgagagggtccttctcttccttcattccccccttttgagactctcactttttattagtgggagttctcactcatttttttacttatgtctttttgtggaatagactgatagtgattcatatagtacagttgtgctgaagcattttgttgaactaaggtagcgatgaagctttttatcatttgaagaagtacaggtagcaaacaagggagcagtaagcaggtttttataattattgtaactcctattataagagttttaaatttttctagtgctgggaaccactttctaaacatggcttcagggttgaatccgtgctacacttgcacaggtacatgtgccagttttgtcatatttttaactatgtctttaataacttgcctgattatctatgtgtagacagtaattagtaaggttaaatttttcacaaactcctccttcagctgctagcaagtagtcaagagctagtctattttgatagattgcatttctcatctgagtctcttgccgggcaagaacggtcaaggcttgaccggttttattagtaaaaatttctaaaacagcttgtaaccatatgattcggttgagcatgtagatgggggtccaatatcctcatgagccatcttgtgcctaagtggcgggtccatagtattgtatgatttttttcagggggctatttatcatcttttcctatggctatgcttcatttttttgttcccaggaagcatagactgggaagcctagaagttcatgtttttatgggcagtaagaagaaagaaggcttaatggtgcgaattacacagctacctgtctactgatcaggcagcttagcataagctttgtgtccacatatatccagtataatccggtgggggccgtccagtcccagtggaattctgggtgggcccaaacagtctgcaactttggaaatttactgaatggatttctttctgtgtaattggaactccaccatgtgactgtttttgtggtactattatagagcttttgtctaagacagctaagctgccttacaggatgagtgaatccttttccttctttagctatgcaatactgtctaataattgagacttttagaacctagagatgatcagggtgattcttttgggctgggaattcatcaggaaatgggtctgtaggaactaattcttgggcttcctatggccattgatctactgttatggttcctccacaaacataatatgaggtgacttgtagagactgggctacgtgttaggctaattgcaaaaagaaatttttagtttttcctggaatctcaggtactggcacatttagttcatcatagaaagtctgaaacactggttctggagagcgtttttgaacctctccttttattaggatgcttacattaggatctagtccctttttatccatgtctaatgatatatatttttcttttattttactttgggtctgaggggtttgtgattatcaattctaaaaggttgtagctcctattcatgcaagaggggctgagttttcctttttggagtcaaacacgatcttttttattttccttttaagtagtctgaatgacacgagaccagtattgacacatctcacataaatatgatttttgacagatatacttattttttttactgtgtaactttcttttttaatttagagaatcacatcctgtttcatgctgcttactattaatagcggcacaagtgtcaaattttaaggttacattttgaggagctctgtttttttcggttctacctattaccttacttgtgtcacatagaaaaggagcagtccttaattttattttaaaaactgtgatcatgggaggcttaaaattgttcataacacacatcaggttggttatttcctgggctacataccttggatagaatagcattatacaaacaatttgttgttgtttttgttgctatttaatttttttagagtcctcgggcgtccgtgatattagtgttagtcagttttgttgtgagtgttagaaagagggcatatagaaccaggaagctgataagaaagacgattatgagggcgtgatcatggaaggcaattagctcttttataataaccataaagtaattagctcttttataataactataaagtaataggactgtagcaatcttttgttccacctcagtgacttgatgtatatactggaaacagttcttagtctgaggaaggtcagttgaagtccttcctgtacaagtccaaattctgaggaaaatgagtcctgcgatgagtctcctcatgcttcagccatgcgtggaccagtcagcttctgggtgtgactggagcagtgtttgttgtcttcttcagagtcattttgcagggattggtgaagctgctcccatccacgtacagctcccagtctactgatgtacagttatgtttaactgggctctctgataataggagtaagatagtgagcttagggtgttgcaaacttcaatggttatgtggggattttcacaatgcaagctttggtatctagttagtctatcatttattagctaatgatgtcctttggtatttattaaaattaccacagcatggggagactttatgtttaggtttttcctaagagttagcttatttgcttcttgtgttaacagggctgttgctgccagggcccttggacatgggggccagcctttggaaaccccgtctagttgttttgagagacaggccattggccttggccaggaacctccagtctgggttaaaactccaactgccatttttttctctttctgacacatagagtgtgaagagttttgtcaggtcaggtagcctcagggctggggccgacatgagttttttttttttttttaactcatgaaaagctctttgctgttggttgtaatagatgtagtttatctaatctacatttttattgactgttatctactaaaatattgacttaaatcttgtaactatttgatttcaagctttaaattgatctggtattccttgcagggcttcgattgcatctaaatagatgtgagagttgaaagacttataaggggctcctctcactttacgatgtgttattattattttttccttcctctggttgatgaaatgccagggtgaaagggatagcccaatggactaaggcacaaatgccactctagttatttggcagagtgcctagtaaaggtccaccacaatactaccacacatctgctcagggatgaacaagggctgattgattgataagctcttgaaaattcttaagctcactgcatccttttaggtctccaaggaatgctaagtttcctccctgccgtgagagacaggaagtgaacttagtgttgagagacagaagctggatggcccttgggggctgactggcagggacttcaggatatagcagagagagcttggcatgacttattactccaggctgtagaatcctggaaaagagctaccatcaggcccacacctggtgaactggaggaccaccgtagtgggaaggggacaattagggcctctggcctgccatgtgcacaagcataacaattgcttttgtttattgtgtagttggaatatttgatccatttcaaccaggcatttgtagcttgatatactgtcttaattgctaaagtttgttttaagtctttaacttttatgatcctctagtaaaatgaatatttccattagcactaatttttattagtttttagaccaaagaaagctaaacatcattttatatttaatgtttcttgtatgatttttataccagataagctaaattttacttttatattagtgtgttattaatattaaacttaattttaataaaaccttgtagacatatttatccaatttttcatagttgaccataaggtaagattttatagactctgtttaaccttttacaatttttgttaaagagcaggttgatgctttaaggaaaaaacctgttgcatttttactttcatgtctagttcacagaaaaactggataatacttttttaactttagctaataagtttacacacagaattttctttaaattaacattttaaaacttgcttgaacttttcaaacaataattcttttttgactttttaatgtaggtaaaaatccacattcttatgcctccttataatcttctcattaaagttatattttacttttttatacacctgcacataaactgtttcttcaatagcactcaggaggccttattacttttaaattatgcaacattttttgcataaaattttttataactttttttcacgactttcgccaacaatttttcaacatgtctcaactttctgacttattacaaacatttttttcttctctttaaacaacaagttaatttatttcaggacaagaatttaccatataacactctttttacataaattttacctcctccccccccttttttttttgaagataaccattccttttttttaaaaagtgaactttctttatgtctttggactagactgtctaaggccacaagattagaagttaccataatatgtgttacactgtcaacttttagcaaacttcgcttttgttgaaaaccttgtaagtttgaaatttcaattatcctttgctattaataagaccttgtttagtctaaatttacttagaattggtatagatggccttttttttttttttctctgctggtctttccttgcctctgccagctgcttatgctgctgttctcttaactattgtgagggggggtggggggaaggggtctaaaaccagctgtaactgtctatgtacagaacctggtctgggtgccttggcttacaggttaccttgtgccataccttagaaactaaaaagacctatctaggcttccttctgatggctaacctacctctaatgctggccaatctatttcacacaaagttctaagttttcctggagtcatagtgactccatagtctctattaaatcctttcttgaaattcattatcatagttcccagtgcagtgggcttactttgtgcctgatctatgtttttttgagacaaaacaccatgctcacagcacacacacaccacaaaacaaagaacgggtaaaagggcacacacaaacatttcagtttacaccaaaccaaaatcaaaaccaaaatcagagtatccagaaatccaagccaggtcaaaaaccaaaaccaaagtatccagcaattcaagtcaagtcaaaaccagatcaaaagtgccaatacaggcacaccgtgggtgatcaggctatgctacacttccattcaggtggagtggggcaagttcaaaagactagtcctaccaagtctagccaagtcaaaaccagaacaaaggtgccaacacaggcacaccgtgggtgaccaggccatgcttctactcaggtggagtgggacaagttcaaaagactagtcttaccaagttccagatgtccagactccaagtgccagttccttcccggtgttcagccactgtgttaatcctccacgggggcctgctacgtgttgatctggtgaggtgttccactggggcaatttcctacccaggagcgctctttggatctcatcactcaggctgcccggagtaccccacagggatgctccacagggcaggcttaagccacctaaggggctgcctcagccttccgtcagtcaccttgcttctgggtcagggagccaagaaatgtagcaggacgagccacagacaaaacctctcagacatcgagttgtagaaggaagggctttattcagctgggaacattggcaagatactgccttaaaatctgagctccccgagtgcacaatttctgtcctttttaagggctcactacactaaagatttcacatgaaagggtcgtgattgatttgagcaagcagtgggtatgtgacaggggctgcatgcactggtggtcagagagaaacagaacagggcagggagtttcacaatgttcttctatacatgtctggaatctatgaataacattggtttctaagttatgagttgagttttaactactaagtttaggccaggcaggcccaggcatagtttcagtcctggcgtttgggctgcctgtctttggttttacttccttgttgttttttcttaaacatgtactgagtgaaaaacaatataaaataatatgagaaggtctttctcttccttcacatgcacattggtcactgatctcgcctactgttaggcttccctgggagcccagttaacaggggaaaatctgcatgacctctcttggtttctcctgtcccaaaatccaacactgatccaagaaggctccagtatgtgccaggcactccctgatcatctggtcttagggggacgcctctaagccatttgattccgttccaggaaccaaaaaggcagaggtgataatagctccttttattgtcttcctccagctgtccaggacagtcttctttttccctgttctccagagcctaccctttgatatggaaaactccccatcctccattccaaaaaacagccctccagactgcctcataaaaaatctgcaaaccttaggcctcaggcaagatacccaccctaagcgccttgtcttttttatacaataaaacctggccgcagtatgaattagataacgggtccaaatggccagcaaatgaaacacttgactttacaattttaactggttaaagcaattattgccgatgactggaaaaatggggagaaattccttgttccaggcctttttgcactcagatcacaacctgacttctgcaattcttgcttacctgttcaaatccttcattctcaccgccctcataacctttctcctcctgaccctacctctttttccttgttggatccagcagactgctgtccacccctcccagcccctacccccacgtctcaaccatcttctataactccccaagctttctcattgtcttcgcagtcaccatcttcccagccaccatcttcccagccggcatcacctccaaaagtacccacttctttttctacaccgtcctctcctcaggaaaactctagcattgcctgtactcagtctccttcctcactgccctctcctgaagcctgtaaacccatcaagccaccttacacccctatgtatcctccactgcctgtcaactcaacccgccttcccccttcaaaccctcagcaggaaccccttctggcttctttcttctctcctgtccataccagcttgggcaccatctttggcccacgctgcacccatacttcagtgcgggtgctagaatgcccccttcaggaagtagcaggaactgaaggtattgttagagttcatgttcccttctccttcactgatctctcaaactaacaagactcagttcatttccagaagaccctacctcttatattagggagtttcagtaccttacccagtcttatgcactaacctggtatgacctctacttatcctgtcttccaccctcaccttctacttatcctctcttccaccctcaccccagaagacagggaccatatttggaccctggttcaggagcatgctaatacaattcatcatcaagctcctgcccagcctactggcacggaggcagtccccaaccaggagccccaccaggattatcaagacagggcctctggacactgccatcaagaccacatgattgtgtatctccttgcaggactcaaaaagggtgcccataaagtggtaaactataaaaacctttcagaaatcacccaaggtcctgacagaaacccagccttttttctctcttgtttaactgaagccatgagaaaatataccaacctagacccagccaacccagaaggaatcactattttaaacctttggttcctcatccaatctacccctgatatttggtgcaagattcagaagcttgacaatggccctgaaaccccacaatgacaccttcttaatttagtcttcaaagtctttaacagttataacgaggaaagtaaaagaaaaaaaaaaaagacagagtttcaaatgcttgcctccaccatcacgggccctgcaggcccacaggctgcagctccacacagatgcctcctagcaatccacctccccctggcacctgtttcaagtgtggcaatgaaggccactggtccaggcaatgcccaaacccaggtaagcccaccaggctgtgccctctctgcggaggaccccactggaagtcagactgtgaggtgccccagcaaggaccgcccccatccctgccccagccggccaaaacctcctactaggatctcatcagccttgccgctgaagactgacagtgccctggaacagatgccccagcaactaccattgcttcatctgagccaaggataaccttgatgttggcagataggccagtattttttttttaattaatattggggcaacctactctgctttacctaaattttcaggacccacccagtcctcccaagtctctgttgtgggaatcaatggacaagtctccaaaccccaagacccccctccacttttctgctccctgcacaccttttccttcagtcactctttcttagtcctgccttcatgcccagctctgctcctaggcagagatattctttcaaaactccacactactctccacttccacattccccatagtacccaacacatcaacccagacccctccaaggcttctaacaggcttctaactttcttctactcctccgacctcccaccctgaagcatgcaacttttccttatcccgcacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccatttttctgttctaaacctaaatgatgctttttcacaattcctttacaccctgattcccaaaatctctttgcctttacctgggagaaccccgacacccacctttcaggtcagctcacctcgtgtgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctctcttttaaacctcttggcagaacaggggtatcaggtctcccctaagaaagcccaaatatgcaccccccagtcacctatctaggcctagctctcactcctgaacgcaagggctcacaacagaccacatattccctccttcagtccctcccgcctccacaaactaagcaagaaattctctcttttccaggattagcgggatattttaggctctgggtttcctccttcgctttacttgccaaaaaattatacgaagctgttaaagtccctctctatgagcctttaaaacctgcacagcctattacccaacctttccatctactccaaaagtctctcatctcagcccccatcctcactctcccagacttcaccaaacctttctccctttatactgatgaatggcgtggagttgcactaggtgttctaacccagtctaaggggcccacccggccaggttgttgcctacctccctaaagagcttgagaccacagttcttggatggcctgcctgcccctgagcattggtggcagctgctctcctcactcttaaaagcctaatactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacctgtccatgctcttacctgaagctacaactgcccaagactctacactcttctgtgtgaatactgttcaaacctttcttataccttttccatacctaacagaccaatcccttccagatgcctcctttatttggtttgtacatggcagctccttcctacatcaaggacactgacatgggggctatgctatagtgtcaccccccaacactattgaagccaatccgctcctcttaggcaccacctcccaaaaagctgaattcaatgccctcactccagctctcactctagcatccggaaaacagatcaatttattcaaattctcattatgcgctccacgtagtgcactcacactcatccatctggaaagaacggggtttcctaactgcaaacaatactcctgtcataagacaagtcttctagtccttgtctgtactttctctgggtaggtagaagaattcccaacaacttcagaaggtgcaactgtcatcgcacaaactcatcatgcatacctgcaattccccgttttggactcccaacatccatccagtctgataacagtcctgccttcatcagccaaattacccgaggcatctctacatccttaagaataaagtaagctctccacacaccctacaggcctcaatcttcaggcgaagttagaaaaattaactctgtctttaaagcccaactcaccaagctggctgtagaaacccaacagtcgtggacaaaaaaaatctccctttcgccctcataagactttgcacaacaccaaaagcacactctttttatagtccctttgaaatcatgtatgaccaaaattttgtcttggggcctccacccttaccagactctgagccactcagaaattaccacccctccttaatccagacatggtctttcatttgtgaagcagcaaatgagccatgcctctccctgtcgacacctcctggtcctctcaacataactgacttgcaggcacagacatgtttccagacaatacagatggtgctcctgctacagcgacatggtggataccaacctgtctctcaagaataccccaaaaattaagttttttttttccaaggtgcccactccaatccctgtgtcatgcctgaagtagttactgagaaagtcaccccttttccctttattctataaccaaataaacaggaagattctccctggggcctgaaagcttgaagggatgagtaactcctcctctcaggcccagttccaagatgcaaagccatttgtgtcaacagcttgcatcagaaagatagcagaagcaggaagagagccaactggaagacacctaccctggctggaagacacatacccctgaagatcaagaaagagaccgtctgggtactacatagcagtcacatcagactgggacacttactgtttacagaggactacaaaacccctgtcccatcctcacttggggctgacgcccctttaggccctagcccacctgcacccaggtgctcattaaaacagcatgttgctccacaccacctcgtggtttctgttggcatgctctcagggtttgaaccgatacaagaacattacaggggtaaaactccacagtaagagggacttctctagctgaactttgtaacaatttgaacaggcaagaagcctcatggccagaaattgggggagggcatgaatctagcttgcagacttcacaggcaggggaagaactaaagcccttttctttgcagctgggaggtggaaaatctcaggcaaatattcaagtccaactctccctcctccttgaaaaagactcgggactattgcaggggccacggtggaagtgggagtggcccttcagtgtgcatgggaggtgggttagaactgagactgctggctttcccacacttccctgacgacctcatgactcagcagaggcagccaaaatccacctaggtacacaactccagtgacctgagaatctcacctccatccccagcagtagccaaagcaaggccctcccaaggaaggtctgagctcaaacacgcctggacctggcccacctggtggtccttccctacccccctggtagcagaagacagaggacctacaatcttgggagttgtagggccgtgaccaccaccagtccctctccacaatactacagctgatgctttctggaaagtaccacctcctggcagaaggccaatcagcagaaaatagagcattaagccaccaaagctaaggacccccacagagtcctttgcaccctccacctgaacaggcactggtatccacagctgagagatccatagatatttcatatcacaggactctgcagacaacccccagtaccagcctggagctggatagacttgctgggtggctagacccagaagagagacaacaatcactgtaatttggctcacaggaagccacatccacaaaaaaaggggagagtaccacaacaagggaacaccccataggacaaaaaaatctgaacaacagtcttcagccctagaccttccctctgacagagcctacacaaatgagaaggaaccagaaaaccaacctgggaatatgataaaacaaagctcgttaataccccccccaaaaatcacactagttcaccagtaacagacctaaaccaagaagtccctgatttacctgaaaaagaattcaggaggttagttatgaagctaatcagggagggaacagagaaaggcaaagcccaatgcaaggaaatccaaaacataatacaagaagtgaggagagaaatattcaatgaaatagatagctgaaagacaaaacaataaaaaattcaggaaactttggacacacttttagaaatgcaaaatgctcaggaaagtctcagcaatataatagaacagatagatgaaagaaattcagagttcaaagacaaggtcttcaattaacttgttccaataaagaaaaagaaaaaagaaaaagaaaatatgaacaaagtctccaagaagtctaagattacgttaaataaccaaatctaacagtaatcggtattcctgaggaagaagacaattcgaaaagtttggaaacatatttgggagaataattgaggaaaacttccccagtcttgctagagacctatacaagaagcacaaagaacacctgggaaattcatcacaaaaagatcttcacctaggcacattttcatcaggttattcaaagttaagatgaaggaaagaagctgggcatattggctcacgcctgtaatcccagacctgatcaggtggtcggaggtgggtggacaacctgaagtcaggagttcgagaccagcctgaccaacatggagaaaccctgtctctactaaaaatacaaaactttgctgggtgcggtggcacatgcctctaatcccagctactcgggaggctgaggcaggagaatcacttgaacccaagaggtagaggttgtggtgagatcatgccattgcactctaacctgggcaacaagagtgaaactccatctcaaaataaaaaaaaaaaaaagatgaaggaaagaatcttaagagttgtgagagagaagcaccaggtaacctacaaaggacaacctatttgattaacagcagatttctcagcagaaaccctataagctagaaaggattagggccctatcttcagcctcttcaaacaaacaattatcagccaagaattttgtatccagtgaaactaagcatcatatatgaagggaagatagccgttttcagacaaacaaatgctgacagaattcgccattaccaagctaccactacaagaactgttaaaggaactctaaatcttgaaacaaattctggaaacacatcaaaacagaatatctttaaaacataaatcacacaggacccaaaagatcattcaaggctgctatgaacacctttatgcacataaactagaaacttagaagagatggataaatttctggaaaaatacaagcctcctaacttgaatcaggaagaattaaatacactgaacataccaataagaagcagcaaggttgaaatggtaatttaaaaattaccaacaacaaaaagtccaggaccagacagattcacagcagaattctaccagacattcaaagaagaattggcaccaatccttttgacattattccacaagacagagaaaagaggaaccctccctaattcattctatgaagccagcatctccctaaaaccaaaaccaaaaaaggacacaaccaaaaaaggaaactacagacctatatccttaatgaacatagatgctaaaatccttaacatgatactagctaaccgaatccaacaacatatcaaaaagataatccaccgtgataacgtgagttttacaccagggatgcagggatggtttaacatacacaagtcaatatatgtgatacatcacataaacagaattaaaaacaaacatcacatgatcatctcaatagatgcagaaaaagtgtttgacaaaatccagcatcattttatgattaaaactctcagcaaaactgacatacaggggaataccttaatataataaaagccatctatgacaaacccacagccaacgtaatactgaatgggaaaaagttgaaagcgttccctctgagaaagggaagaagacaaggatgcccactctcaccactcctcttcaacatagtactagaaatcctagccagagcaatcagaaaagagaaagaaataaaggacatccaaatcagtaaagaagaagtcaaactgtccctgtttgctaacaatatcattgtttaccttgaaaatcctaaggactcctccagaaagcacctagaactggtaaaggaattccacaaagtgtccagatgcaagattaatgtacacaaatgagtagatcttctatacaccaaaggcaaccaagcagagaatcaaatcaagaactcaaccccttttacaatagctgcaaaaaagtaaagtagagtaaaatacttaggaatatacctaacaaaggagtcaaaagacctgtctacaaggaaaactacaaatcactgctgaaagaaatcatagatgacacaaacagatggaaaaacatcccatgctcatggatgggtagaatcaatattgtgaaaatgatcatactgccaaaagcaatctacaaattcaatgcaatctccatcaaaataccacgatcattcttcacagagttagaataaacaattctaaaattcatatggaaccaaaaaagggcccacacagccaaagcaagactaagcaaaaagaacaaatctggagccatcacactacttgatttcaaactgtactctagggccatagtcaccaaaacagagtggtactggtataaaaacaggcacatagatgaatggaacagaatagagaaccccaaaacaacacaaatacttacagccaactgatctttgatgaagtaaacggaaacataaagtggggaaaggacacccttttcaacaaatggtactgggataattggctagccacatgtaggagaatgaaactggatccttatctctcaccttatacaacaatcacctcaaaatggattaaagacttaaacctaagacctgaaactgtaactctagaaggtaacattgggaaaacccttctagacgttggcttaggcaaggatttcatgaccaaaaacccaaaagaaaagcagtaaaaccaaagctaaatagctgggatctaattaaactaacttttgcacagcaaaaggagcaggcagcagagtaaacagacaacccacagagtgggagaaaatcttctcaatctatacatctgacaaagtactaatatccaggatctacaacgaattcaaacaaatcagtaagaaaaaaaaaaccccaataaaaagtgggctaaggacatgaatagacaattctcaaaataagtatacaaatgaccaagaaacatatgaaaaaagtgctcgacatcgctaatgatcaggcacatgcaaatcaaaaccacaatgcaatactaccttactccttcaagaatggccatagtaaaaaaatcaaaatacagtagatgttggcatggatgcagtgatcagggaacacttctacactgctggtgagagtgtaaactagtacagccactatggaaaacagtgtgacgattccttaaagaactaaaagaactaccatttgatctggcaatcccacttctgggtatttacccagaggaaaagaagtcattattcaaaaaagatacttgcacatgcatgtttatagtagcacaattcacaactacaaaattatggaaccaacccaaatgtccatcagtcaatgagtggataaagaaactggtatatccatatgatggaatattactcagccataaaaattaatgaattagtagcatttgcaatgatctgaatgagattggagattattattttaagtgaagtaactcaggagtggaaaaccaaacatcatctgttctcaatgataatgtgggagctaagctatgaggacacaaaggcataagaatgttacaatggattttagggacttgagcagaagagtgtgaggaagcaagggataaacgacaacatatgtggtacagtatgtactgcttgggtgatgggtgcaccaggatttcacaaatcaccactaaagaacttatgtaaccaaataccgcctgcacgccaaaaacctatggaaaaataaaaaaaatttaaaaaatgaaatcatacaatgtatggtctttagtgagtggcttcttgtgcttagcataatgtattaaaggttcacccatggaagagtgtatataaggacttcatttctttctattgtcaaatagtactccaaagtgcatatatactcattttatttgttcatttatcagttggtagacatagattttttccatttttgatgattatgaataatattgattaacatttatgtacaagttttctgtggacatatttttatttctcttgggtgtatatctagaagtggaattactggattacatggtaaatgtatatgtaaccttttgaggaattgctaactgtttttcacagtggcagaattattttccattctcaccaccaatgcatgatggctttaatgtctccataaccttgtcaatggttgttatcctatgttttttgattacagccagtgtgagtgaagtgatatctcattatgatttatatttccttcatatctaacaatattgagcattcttatgtgctaatttcccattatatattttcttagaaaaatttctattttgatactttgcccattttgattatttgtcctccttttatggacttatgcatttaataaatttttgacataagtcccttgtcacatatatgatatccaagtatattatcttatttttttggttgtctttttactttcttaatgatgtccattgaaacacaaaaatattaattttgatgaaatcctatgaatcaacttgaattgggtcacttttatttttagtgtcatatctactaaactatccccaaatgcaaaatcatggacattagcaaccatgtttcattattagagttttacagttctattgcttacatttagcttttaacttattttgagttaatttttgtaagtggtttgaggtagggggccaacctctattatttcgtatatggataatcagttttctcaattacatttgttgaataatctattctttgactcattaaattgggcactttggtcaaaaaccataaatgcgtgagtatattcctagattccaaaatctattacactgatttgtatgcctaccttatgtctgtatcacactctcttgattattgtatattggtatttgtctttaaaagcagaaagtgtaagccttccaactttgttttttattttaaattgtttcagctatttttttttcttctagcttttttttttttttttttttttttttaaggcaggggtctcactacatttcccaggctgaactagaagtcctgggctccagcaatcaatgaatttcagccacctgagtagctggggctacaggtgcatgccactacatctaaattgtttcagttattactgtctcctacatatctacatacattttagaatcagctagtcaatttatgcaagaagttatctgggattttaatagggattgaattgaatctgcataacaatttggggagcagagtatgggcattgtcacaatattaggtgtttcaatacatgagtataagatgccttttcatttatttagatatcatttaatttatttccataatgttttgtagatttcacagggcaagttttactctccttttgttaaatttattgatggccaggcgtggtgactcacacctgtaatcccagcactttgggaggcctaggtgggcagatcacaaggtcaggggttcgagatcagcccgacctacatggtgaaaccccgtctctactaaaaatacaaaaattagccaggtgtggtggtgcatgcctgtaaccccagctactcaggaggccaaggcaggagaattgcttgaacccaggaggtgaaggttgcagtgagccgagatcatgccactgcactccagcctgggctacagagtgagactccatctcaaaaaaaaaaaaaaaaaaaagagaaaaaaattattcacgaactgtatttttgtgctattttaattgtgattgttttaatcgttattttagcctaaatttttattgcaattagggagaaataactttttttttattgatcctatatcctaaaaccttgctttattggtttactgctctaatatttttctagcggatttgtaaatgtttactattataacattatgacaaaagccaataaagatagcttaacttgtttatttctagtatggagtcttttattctttcattttttaaaccaatttatcttatctagaacctctaatacagtgttgaatggaagtgagaaaagccaatttagtctttctccattaagtgcggtgtcagtgtgtgttttatttatagatactatttgtcagtttaaggatgtttctgaaaggtattgcattaatcacatgattttttctgcctttattaaaatgattatgcagttattgtccttattctaatgatattacatattcaccagttttttgagatgttaaagttagtttgcatttctggcataaaattcccttctggttaaagttagtttgcatttctggcataaaattcccttctgtatgtccaaagctttttgcacatgctagggttctgtttgctagtgtgaaagaaaaataaagaatcaagatcctaaagtcactatgccaaagggaaaaaagtttagcttgggaactgagtcacacaaactgtcagaggcattctaaccagagtgattccaccttgaataagtcagacaaggtcaaacctgccaggttacattcccaggggattgagcactcttggttacaagatactcatggttgagggaatgagttaatgatgataattaactaaataaagacccagaacttatgaaaatgtcccaatagtttgaaaacaaaaacttcttaatttaagaattagttttcctttaaaaaactagcccacttgtaaaatcttgctgaaatcaataatacataggaaaataacaatattaatagcctgtcacaagctgatcacaaacctttgtaataaagtacagtattcttaacaacctatataagcaagcactaagtttaaggtaggggtatttctcttcttgctttctgaggatgccctattctgtaatagagtagtctctaacaaactgttaattttactgtactctgcgactcaccttgcattctttcccacatgagatccacaaacccacccttaacgtctgggacaagaccacttttccagtaatattttcctctggtgactctgctgggacctaaatgaggtgagattccaacccaaaggaaatagactatgcaacaccaattggctgatttgggtaagtggtggaacatatttttatactcgaacagagacactgttcaaaatcggtttagaggcccaacttaggacagttagaggcccttctgacagataagaggtttagaggcctttccgaaagctaagggggttagaagcccttcacaacaagaaatgggttcaatgctacaaaatgttaattactactccctttcaattagccctccctgtgctctctgtcattcactaaagactgtctgctgtctgccaattttctgactgctgactatacttactgtttctttgcagagaccttgcttgatggtcctgagatttttaactttcacgttcctcatttgtctttggattagtggccctttacttgtgtgcttcggcatgttgctaaaagacattagagatgaatggctctgcaagatttactttccctatatctagcccattcgaatgaattatttattgtctcatctctcaaaagattaattgaaatttggtacttacaagttttggtccagtgtgcacgatttagcccagtagcaattatgccaatctcccatgggtgaacagctcccagaaggagaactggagatttctttttggaaattctttttcatcccctcactaatcaactgacctttatttcttgattatgaacagcatgatcatgtaagttttaccctacttaccattactatccttaacctggacattcctctctggatgcatatcatttcccttacttagtgtgacatttctttggtcaggccctctattgtagattctctagttcaggtgactcagctcatttatattatgcgactaacaagaatgccagaattaagtcaactactgaatcattttcccttgcttgtttagctctgaaagctcctttatcctttttagtgaagcttgccctgtggcagcactaccttgttcacaaggatctctaccttcacctgctctgctcctgtgtaatacagctttgatcctgaagagttctgagttctccactaggatgtctagtagagcattggaacaaatttcaattaggtgagcttaagaaaaataaattgacatttttatgtaatactgtttggcctcattatgatttggaatatcaagataaatggccacctaatggaaccacagcctttaatattatacatcaacttgatttgttttgcaagtgggagagaaaatgaggtaaaataccatatgttcaagcatttttattgcttagtcaggatgaaactttacagcaagcgtgtgcatgtttaatgaaaggaaggaaagaaaaggaattagatatactagatgaccctttaatgcaagtcccctgagtccaatgggtgcctttgggtggaacagtacctccctgtgtcagctctaatgcttcaggtgcatctccctctgtctcttctagcccttctagtagtcctgtttagacactttcattcccttctccttacccgtctagtctaattttatacctacctcattctgagaggcccagtcctattctgtaactgtcactccctgaggaggccagccttgctagtactacccagagtggagcctcttctcagtctccaaaggaaaatctttgttggcttagagaagtggcaaatggggaagagcgcactataaggtccctttccccatgttttttttttggtcttatgtaaaggttatttctctgaagacccaggaaaatgtatagataaatttgagaagctaatgctgacttataatttgacctggtaggattttcatattttgttatccacatgttgtacagtggaagaaaaacaatgaattttgggattagctagaatacattcagacaaagtactagcctgcaatcctaatgatatctatagaacaaggggtatttcagtgcctgattaagatctaggattgaactatcaaagaaataggagggcttacagaagagagatcatatgattacttggttattaaaagagaggagagatgtgtgaaaaagtctcttaattattataaggtgaaagaaattactcaaggtaaagatgagaatccagcattatttcagggaaatttggttgaggcaattagaaaatatactaaaattgatcccatttcaatggaaggacaaaccttactggggctgtattttataacccagtctgccactgatgtctgtcagaaactacaaaaagcagcctgggtctgcagacatctatgaatcaacttttcagtatggcatttatggttcttaataacagatacatggcagaggaagtgaaaaacttaagagagcctcctaaaaggcacagtttttagctgcagcattaagcttaccaaccacgtgagatcatccttacacttcttagccatggcaaaggaagctggaaggcagaaagccacaagctggggttctaagcactgcaccttgggtgtaaatcaatgtgctcactgtcataaaattggctattgaaagagggaacacccagcactccaaagtgagtctttggcccctgaacaaatgatggcagttcaagagtgacagggccctagagcttctgtcacagctcccattggacaattagccatatctccagaggagcttcgggtaatcattgatgtgacaggtaacaatattaatttccttttggacatgggtgcttcttactctgttttgactcatcataatgggccattatcatcccaagactctgtggtcatggggataaacggacgagctcatagactccattttccctatcctccaagctgctcttcagggactcttgttttttcgcatgcttttcttataatgcctgaatgtcctactccattttcaggaagagatttatgaactcagctgcaaactctggttttcttcagagatcacaaggcagatgattgattgcttttacttgtctcccatgataagggaagaaaaattaataggagacactctcataatatcttgctatctttacttataccctctttgcagaaagttgaaatttaaaaagggaaaagtaactaggcattcactagaattaggttaactaaaaatttctctgcagagctccttactaggcataggaactacagcaagcatcctgaaggagtctcattagagtgtcttttagacaattgctccaaatatgtccacatagtaaagaaaagatgacacagaacaacatacacaatcaagtatacaaccactacttggtagcattaggggaagttccatggatagatgcttgtaggagctataaaaagaagtggttttggaaggaatcaaaatgagacaaagaccttaaaactaggaaaaaaatgtatctacagagttcagggaatttctgctataaaaattaattgtaacaataaattgtaaaaaaaatgacaagaaaagccaaattgtaatgaaagtgatctgcctaggttacagcagaggcaatcaataaattattctgatgttctcacaatgcagaatatgaagaatgtttgcagaaatcaatacctgttgaagattaactaatgaaaaccaaatgaagaaataaccaactatatacaatatacaatagtatacaactatatacaatatacaatagtttacaatagtatacaactatatactatgtataatagtaacatttgcaccaaaggattatagatatagaaaataaatcaaaatgatgttttataataaacatagttcaaatgtccagagatgaaaaatagttcatataatatatgtatggaaaatgacgagaaccataaacataaaaagaaacacatcaattctagaaattagaaataaactcactggttacactaaaatgtaattgataacatgaaataaaatggaactgaatgaatgaacaaaagaacaaacaataacagcagtagaaagaactagtgaatctttctatttttctccctgaatcttgactcatagagccccaataggaatcacctaatactctaggaattgccactaagctgattaaaatataaaagtgttatttgttaaaaaagaaaaaaaagctgaattagtgctctcccgattgcctgctttattcccaaaactctcttatttctaattgttttactggtcttaatcattcatgctatgtttcactgaagtatttgtgaaatatttcatgtgtttatctcaattttgattttatctcaattttggtttcattctatcttgactcttgcaacctgcatgtcctcattttactttaccaatccagctccaaagacaaccttctcatagacctaggatttctcattaaatttttaccagtttatctgagcttcattgatcttgtttctctgccaattactctgagccactgtcatcatgacctaaaattttttcacaaattacaaatttaccctttataatttatctgtgtcaaggaagactctgtagacaataccagaagaaaaaaatgtgtgcagtacatgaatgaaaaacctgatgtttcctgactttttgatgattgtcattctaactggtgtgagatgatatctcattgtggttttgatttgaatttctctgatggccagtgatggtgagcattttttcatgtgttttttggctgcataaatgtcttcttttgagaagtgtctgttcatgccctttgcccactttttgatggggttgtttgtttttttcttgtaaatttgtttgagttcattgtagattctggatatgagccctttgtcagatgagtaggttgtgaaaattttctcccattttgtgggtggccagttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataatgtgtaaggaagggatccagtttcagctttctacatatggctagccagttttcccagcaccatttattaaataggatgtggagaaataggaacacttttacactgttggtgggactgtaaactagttcaaccattgtggaagtcagtgtggcgattcctcagggatctagaactagaaataccatttgacccagccatcccattactggatatatacccaaaggactataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccacatattctcactcataggtgggaattgaacgatgagatcacatggacacaggaaggggaacatcacactctggggactgttgtggggtggagggaggggggagggatagcattgggagatatacctaatgctagatgacgagttagttagtgggtgcagcgcaccagcatggcacatgtatacatatgtaaccaacctgcatattgtgcacatgtaccctaaaacttaaagtataataattaataaataaaaaaatgaaaggacaagagtaggaaagtgtaaaaaaaaaaaaagaaaaacctgactgaatcataaacaaaaataggcaattagattaaaaatttagtatttgctaattaaatcaatgatagatttttatatactttggattggtaaaaattaatatcaccataggggaagaaccaactacctggccactccagtgctgtatagagtggcaatagtagaaagatacacacgggctcaacaaactctctctacttaaaactaaggtagctattactgaaatcaaaaattcaacctgctaatatgtaaattctgatcatacctttagagatcagagaagtgaccagtagtgaggctgcagacacaatgaaacaactctaatctcaccttgttatgaactgtatctgctcctgtgttgaagagcttcatttgcgtaagattttgctttttcttcatctgaattttactatgaggcaatgcacaagattttaacaacctatagatactaactgatatgatttggctgtgttcccacccaaatctcatcttgatttgtagcttttataattccatgtgttgtgggagggacctggtaggagataactgaatcataggagcagtttcctccatacttttctcatagtagtgaataagtcttatgagatctgatggttgtataaagggcaacacctcttgcttgggtcgcaatactcacttgcctgctgccatatcagtttcctccatacttttctcatagttgtgaatgagtcttttgagatctgatggttgtataaagggcaacatctcttgcttgggccgcaatactcacttgcctgctgccatatcaatttcctccatacttttctcatagttgtgaatgagtcttttgagatctgatggttgtataaagggcaacatctcttgcttgggtctcaatactcacttgcctgccatcatatcagatgtgactttgctcctccttcctttccaccatgattgtgaggtctccccagccatgtggaactgtgagtcattaaacttcgttcctttttgaattactcagtcttgagcatatctttattagcagcatgagaaagaccaatacagtaaattggtactaggccatagggcactgctataaagataccagaaaatgtggaagcaactttggaactgggtaacaggcagaggttggaacagtttggtgggctgagatgacaggaagatgtggaaaagtttggaacttccttaagacttgttgaacggctttgaccaaagtgtgataatgatatgaatgataaaatccaggttgaggtggactcagatggagttgaggaatgtgttgggaaatggagtaaaggtcaattgcgctatgcaaagagactggtggcatctagcccctggcctagagatatgtggaactttgaacttgagagagatgatatgaggtatctggtggaagaaacttctaagcagcaaaatattcaagaggtgacagagtataaaagttgggaaaatttgcagtctgaaaatgcagtagaaaagaaaaccccattttctggggagaaattcaagttggctgcagaaatttacataagtaatgaggagccaaatgctaatcatcaagaaaatggggaaagtgtttctggggcttatcagagaacttcacggtagaccctcccatcacagattgtagggaaaagaaagagagatcagactgttattgtgtctatgtagaaagggaagacataagaaattccattttgacctgtaccttgaacaattactttgctgagatgccggtaatttgtaactttgccccagccactttgcctcagccactttacctcagccactttgccccaactttgagctcacaaaagcatgtgttgtatggaatcaaggtttaatggatctagggctgtgcaggacgtgccttattaacaaaatgtttacaagcagtatgcttggtaaaagtcatcgccattctctagtctcaataaaccaggggcacaatgcactgtggaaagctgcagggtactctgcccttgaaagccaggtattgtccaaggtttctccccatgtgatagtctgaaatataacctcctgggatgagaaagacctgactgtcccccagcccgacacccgtgaagggtctgtgctgaggtgggttagtaaaagaggaaagcctctcgcagttgagatagaggaaggccactgtctcctgcctgcccctgggaactgaatatgtcggtataaaacccaattgtacagttgttcaattctgacataggagaaaaactgccctatggcagtaggtgagacattttggcagcaatgctgccttgttattctttactccactgagatgtttgggcagagagaaacataaatctggctacgtgcacatccaggcatagtacctccccttgaacttaattatgacatagattcttttgctcacatgctttttgctgacattctccttattatcaccctgctgtccgacacattcctcttgctgagataatgaaaataataatcaacaaaaactgagggaactcagagactggtgccagtgcaagtccttggtatgctgagtgctggtcccctgggcccacttttctttctctatactttgtgtactgtacagtctccaacgggcattatttttcaaaatacagaccttgtgcggtggtcattccttcctcacagtataattaagacttttacattgtatttagatgaaatggctgcattaattggtcaggcaagactatgaatagtaaaatcgtgtggaagtgacccagatgaaatcattgttcctttaaacaaggaacaggttagacaagccgttgtcaattctggtgcatgacagattggtcttaccgattttgtgggaattattgataatcactacccaaaaacaaaaatcttccatttttaaaaattgactacttggattttacctaaaattaccagacataaacttttagaaaatgctctgacggtgtttactgatggttccagcaatggaaaagtggcttacacaggccaaaagaatgagtcattgaaactcaatgtcactcagctcaaagagcagagttggttgctgttatttcagtgttacaagattttaatcagcctattaacattgtttcagattctgcatatgtagtacaagctaaaaaggatgttgagacagccctaatcaaatatagcatggatgatcacttaaaccagctgtttaatttattacaacaaactgtaagaaaaagaaatttcccattttatattactcatattagagcacatactaatttaccagggcctttaaagcaaatgaacaagctgactcgctagtatcatctgcattcataaaagcacaagaacttcatgctttgactcatgtaaatgcatcaggactaaaaaataaatttgatatcacatggaaacaggcaaaaaatattgtacaacattgcattcagtgtcaagtcctacacctgcccactcaggaggaaggacttaatcccagaagtctaagtcctaatgctttatggcaaatggatgtcacatatgtacctcatttggaaaattgtcatttgtccatgtgacagttgatacttattcacatgttgtatgggaaacctgccagaaaggagaaagtacttcccatgttaaaagacatttattatcttgttttgctctcatgggagtatcagaaaaaattaaaacggataatgggccaagatactgtagtaaagcatttcaaaacttcttaaatcagtggaaaattacacataaaacaggaatcccttatgattcccaagggcaggccataattgaaagaactaatagaacactcaaagctcaattggttaaataaaaaaaaggaaaaagagagtagaagtgtaacacttcccagatgcaacttaatctatctagcacactatactttaaattttttaaacatttatagaaatcagaccactacttctgcagaacaacattttactggtaaaaagaacagaccacatgagggaaaactgaattggtggaaagacatgaaaaataagacatgggaaataggtaagatgataacatgagggagaggttttgcttgtgtttcaccaggagaaaatcagcttcctgtttggatacccacaaggcatttaaaattctacaatgaacccatcggagatgcaaaaaaagtgcctccacagagacagaaaacctgcaatcgagcatcatctactcgccaggtgaataaaatggtgatatcagaagaacagaggaagttgccatccaccaagaaagcggagccaccgacctgggcccaactaaaaaagctgacacagttagctgaaaaaagcctgaagaacacaagggtaacacaaactccagagaatatgctgcttgcagctttaatgattgtatcaacggtggtaagtctccctatgtctgcaggagcagctgcagctaattacacttactgggcctatgtgcctttcccgcccttaattcgggcagtcgtttggatagataatcctattgaagtatatgctaataatagtgcatgagtgccaggccccacagatgaccgtggccctgcccaacctgaggaagaaggaatgatgataaacatttccattgggtatcattttcctatttgcctggggaaggcaccaggattcttaatgcctacaacccaaaattgattggtagaagtacctactgtcagtgccaccagtaaatttacttatcacatggtaagtggaatgtcacttgggtcacaaataaataatttatagcactcttcttattaaagatcattaaaatttaggcctcagggaaaaccttgccccaaggaaattcgcaaagaatcaaaagacccagaagtcttagttcaggaagaatgtgtggctgatactgcgatggtattacaaaacaataaatttggaactattatagactgggccccttgaggccaattatattatgattgtacaggccagactcactcatgttcacaggccccatctgtctggcccactaatctggcctatgatagtgatttaactgaaaggctagaccaggtttatagaaggttagaatcaccctatccatggaaatggggtgaaaagggaatttcatcacctcgaccacagttagttactcctgttactggtcccgaacatccagaattatggaagcttactgtggcctcacaccacattagaatttgatctggaaatcaagttatgggaacaagaaatcataagccatattatactattaacttaaattcctttgcaaagttgtggaaaacccccttatatgctagttgtaggtaacatagttattaaaccagattcctaaactataacctgtgaaaattacagattgtttacttgcattgattcaacttttgattggcagcaccgtattctgctagtgagggcaagagagggcgtgtggattcctgtgtccatggactgaacgtgggaggcttccccatctgtccatatgttaacagaagtattaaaaggagttctaactagatccaaacgattcatttttactttgattgcaatgattatgggccttattgcagtcgcagctactgctgtggctgctgtaattgctttacactcctgtcttcaaactgcagaatatgtcaataattggcaaaagaattcttcaaaattgtggaattctcagacccaaatagataaaaaaattggcaaaccaagttaatgatcttagacaaactgtcatttggatgggagattgacttgtgactggaatatgtcagatttttgtattaaacctcgagcctgtaatgaatctgaatatcactgggacacggttagacaccatctacaaggaagagaagataatattaccttagatatttcaaaattaaaagaacaaatttttgaggcatcaaaatcccagttaaatctggtgccagaaactgaggaaatggtgaaagctgctgatagcctcacaaatcttaaccccgtcacttgggttaaaaccattggaagttccactattgcaaattttgtattaatccttgtgggtctgttctctctgttgttagtctacaggtgtatccagcagttccagagagacagcgaccagtgagaatgggccatgatgacgatggtggttttgtcaaaaagaaaaaggggatatgtagggaaaagaaagagagatcagactgttactgtgtctatgtagaaagggaaggcataagaaattccattttgacctgtaccttgaacaattgctttgctgagatgctggtaatttgtaactttgcccagccactttgccccaacttcgagctcacaaaaacatgtgttgtgtggaatcaaggtttaagggatctagggctgtgcaggatgtgccttgttaacaaaatgtttacaagcagtatgcttggtaaaagtcatcgccattctctagtcttgataagccaggggcacaatgcactgcagaaagcgcagggacttctgccgtggaaagccatgtattttccaaggtttctccccatgtgatagtctgaaatatggcctcatgggatgagagacctgactgtcccccagcccgacacccatgaagggtctgtgctgaggtggattagtaaaagaggaacgcctcttgcaattgagatagaggaaggccactgtctcctgcctgcccctgggaactgaatgtcttggtataaaacccgattgtacatttgttcagttctgagataggagaaaaaccaccctttggtgggaggtgagacatgttggcagcaatgctgccttgttattctttactccactgagatgtttgggtggagagaaatgtaaatctggcctacgtgcacatccaggcatagtacctccccttgaacttaattgtgacatagattcttttgctcacatgtttttctgttgatcttctccttattatcaccctgctctcctactgtattcctcttgctgagataatgaaaataataatcaataaaaactgagggaactcagagactggtgccagtgcaggtccttggtatgctgagcgccagtccactgggcccacttttctttctctatactttgtctttgtgtctgatttcttttctcagtctctcatcccacctgatgagatataaccacaggtgttgaggtgctggccaccccttcacacctatggatatatcttgacaggtgggtcacacaaattgggaaaatttgcagtagaaaagaaaaccccattttctgggcagaaattcaagttgtctgcagaaatttatgtaagtaatgagaagccaaattctaatcatcaagaaaattgggaaaatgtttctggggcatatcagagaacttcacggcagaccctcccatcacaggcctggagtcctaggaaggaaaatggtttcacaggccaggcctagggccccccatgctctgggcagcttcaggacatgatgtccttcatccaagctgtttcagctccagccatggctaaaaggggccaaggtatagctcaggccattgcttcagagggtgcaagccccaagccttggtagcttttctggggtgttgagcttgcaggtgtacagaagtcaagaactgagttttgggaacctgtgcttagatttcagaggatgtatggaaatacctagatgtccaggcagaagtttcctgcatgggcgggaccctcatgcagaaactctgctagggtagtcagaagggaaatgtggggttgaagtcccaacccagtgtcgccactggggcaccacctagtagagctgtgagaagagggccaccatcctccagaccccagaatggtagattcactgatagctttcactatgtgcctagaaaagctgaagacactcaatgccagcctgtaaagtagcagggagggaggccctaccctgcaaagtcacaagtgtgaagctgcccaagaccatgggaacccactacttgcattagcgtgacctggatgtaagacattaagtcaaaggagataattttggagttttaatatttgactgcccctctggattttagattcacatgaggcatgtagcccctttgtttttgtcaagttctcccatgtggaatggctgaatttacccaatgcctgtactcccatgtattgaggaagaaactaacttgtttttgattttacaggctcataggtggaaggaacttgccttgtgtcagctgagactttggactgtggacttttgaattaatgctgaaatgaattaaggctttgggggactgttggaaaggtatgctttgttttgaaatgtgagggcatgagatttggagaggctgagggcggaatgatatggtttgtctccacccaaatctcaccttgaattgtagctcccataatttcatgtgttgtgggagggacctggtgggagataattgaatcatgggggcaattttttccatactattcttgtggtagtgaatgagtctcaatagatctgatttttttttttttttttttttttgagacggagtctcactctgtctcccaagctggagggcaatggcacgatctcggtttgctgcaacttccacctcctgggttcaagccattctcctgccccagcttcctgaacagctgggactacaggcacatgctggtacatccagctaattttttgtattttttttttagtagagatggggttttaccatattgcctgggctggtctcaaactcctgaactcaggcaatccgcacacctttgtctcccaaagtactaggattacaggtgtgagccaccacacctggcctgatctgatgattttataaaggaaacccctttcatttgggtctcaatgttctcttgcctgccaccttgtgatatgtgaatttgctccttcttgccttctgccatgattgtgaggcttccccagccatgtggaactgtgagtctgttaaacctctttcctttataaattactctgtattggatatgtctttattggcagcacgagaacagactaacacagtaacaaatgagaaatttataatattgttgtctgctataccacttttcaatttgttgaaggtggagatttttaagcagtaggaaatccttagatggttattacaaaataggatgattataatgaaaattaatgtgcttaaaataaaggttttaatacaatatcatcagaagttgggagaattaatggaacccctagaaagttcccgaaccctcagacttccaagccaatctgctccatttatcacagtttggagtagtttacaaagcacaaatgcagaaatcacaatgtgaaaatttattaacgctttcctcagataatattgagatattaatcaagataaaagtttgcaaaaaggcaagcgtctcttggctcaatcaccttgtacagacacaaaacacattaagtcctaatagagcctaagtaaaggttaatgaaatgaagataaaaggttatagaaaagttggtatatatccacaagctttatgtgaagtagttacatctcttttatctgacagtattattagaatggacattgtatctaactgggaaatgtttcccacatctagtattatacaatggaaggcatccaaatttgtctttaaatcattatgaattgggcattctaaatagaagccagtaagatattccatccaagttcatacagtgtagaatagaagctggagtgctgatagaaaaaaattctctgttcgatagccctatatcaagcataacttatagtaatatgctgtgagtatctcccagtgataaatactgggatttgggaaaggagaatttccacttgagtggcatttactaccttgctgtagtacattaattgaagctatccataacagttcatcaaataaccttgaaacatgaaatacccatgatgtcttgcataatgtaaatgaaacactccagtcatatagcagtacccagaagagttttgtactacaatggaaattgtctatatagaatcaaactgcgtcatgaatgcctgaaggagatattcttaagctcagaacccctttcctcctaggactgattctgaaactgtgtgaggagttgcctaattccacagtgctctataaatagctcacaactgactgacaaagatctgctaggcttgtagatggcacttacagggtgaatgaacaaactactgccatattgattctttttttctagttcttatgtaaatcctttttaaaaaaagggtttttttttttttttttttttttttttggaatggtctcactctgttggccaggctgaagagcatacaattacagtttactgcagcctcagcctcaaactcccaggctcagatgattcaccaacttcagtcccccaagtagctgggactacaggcatacatggccatgcctgacatttttaaaaagctttatttgtaggtatagggtctcactataatgccctggctggtgttgaactcctaggcttaagtccttctctcaccttagcctcctagaatgccaagattataggtgtgagctgctgctgtatctggtctgtaaatccttttttctgtcttcatcatttattggcttccttggaattaagggattatcttgttgtatgtttttatttcttcctttttatttttagggtatttattataggtgttctgtgcttatcataaggcttacatgaaaacaccttcttttttattatactttaagttctagggtacatgtgcacaacatacaggtttgatacataggtgtacatgggccatgttggcttgctgcccccatcaactcatcacttacattaggaatttctcctaatgttatatccctcctccagccacccacccccaacaggccccagtgtgtggtcctctgccctgtgtccaagtgatctcattgttcaattcccacctatgagtgagaacatgcattgtttggttttctgtccttgtgacagtttgctgagaatgatggtttccagcttcatccatgtccctgcaaaggatatgaactcatcattttttatggctgcataatattccatgctgtatatgtgccacattttcttaatccagtctatcattgatggacatttgggttggttccaagtctttgctattgtgaatagtgctgcagtaaacatacgtgtgcatgtgtctttatagtagcatgatttaaaatcctttggatatgtacccagtaaagggatcgctgggtcaaatggtatttctagttctagatccttgaggaatcgccacacagtgctccacaaaggttgaactaatttacactcccaccaacagtgtaaaagcgttcctatttttccacaccctctccagcatctgttgtttcttgtctttttaatgattgccgttctaactggtgtgagatggtatcttattgtggttttggtttgcatttctctgatgaccagtgatgatgatcattttttcgtgtatctgttggctgcatagatgtcttcttttgagaattgtctgttcgtatccttcacccactttttgatggggttgcttgtttttttcttgtaaatttgtttgagttctttgtagattctggatattagccctatgtcagatgcgtagattgcaaaatttttctcccattctgtaggttgcctattcactctgatggtagtttcttttgtcatgcgcaaaagctttttgtttaatttgatcccatttgtcaattttggcttttgttgccattgctttttgtgttttagtcatgaagtccttgctcatgcctacatcctgaatggtattgcctaggttttcttaaagggtttttatggttttaggtctaacatttaagtctttaatccatcttgaattaatttatgtgaaaagtgtaaggaagggatccagtttcagctttctacatatgtctagccaattttcgcaccaccatttattaaatagggaatcctttccccattgcttgtttttgtcaggtttgtcaaaaatcagatggttgtagatgtgtcgtgttatttctgatgtctctgttgtgttccattggtctacatctctgctttggtatcagtactatgctattttggttactgtagccttatagtatagtttgaagtcaggtagcaagatgcctccagctttgttatttttgcttaggattgtcttggctgtgtgggctcttttttggttctatatgaattttaaaatagtttttttccaattctgtgaagaaagtcattggtagcttgatgggaataccatcaaatctataaattaccttgggcagcatggccattttcatgatatttattctttctatccatgagcatggaatgttcttccatttgtttgtatcctcttttatttcattgagcagtggtttgtagttctccttgaagaggtccttcacatcccttgtaagttggattcctaggtattttattctcttagcagcaattgtgaatgggagttcactcatgatttggctctctgttggtctgttattgatgtttaaaaatgcttgtgatttttgcacgtccattttgtatcctgaaactttgctgaagttgcttatcagcttaaggagattttgggctgaaaagatgggtttttctaaatataaaatcatgccatctgcaaacagagacaatttgacttcctcttttcctaattgaatactctttatttctttctcttgcctgatcaccctggccagaacttccaacactatgctgaataggagtggtgagagagggcattcctatcttgtgctggttttcagagggaattcttccagtttttgcccattcagtatgatattggctgtgggtttgtcataaatagctcttagtattttgagatacgttccatcaatacctcgtttattgagagttttagcatgaagagttgttgaatttcattgaaggtcttttctgcatttattgagataatcaagtggtttttcattggttctgtttatgttatggattatatttatttatttgcatatgttggaccagccttgcctcccagctgacttaatcatggtggataagctttttgatgtgctgctggattcggtttgccagtattttattgaggatgttcgcattgatgttcttcagggatattggtctaaaactctgtttttttgttgtgactctgccaggctttggtatcaggatgatgttggcctcataaaattagttagggaggattccctccttttctattgattggaatagttttagaaggaatggtaccagctcctctttgtatctctggtgaaattcagctgtgaatccatctggtcctggactttttttcattggtagcctattaattattgcctcaatttcagagtctgtttctggtctatgcagagattcaacttcttcctggtttagtcttgggagggtgtatgtgtccaggaatttatccatttcttctagattttctagtttatttgcgtagaggtatttatagtattctctgttggtagtttgtatatctgtgggatcagtggaggtatcccctttatcattttctattgagtctatttgattcttctctcttttcttttttattattcttgctagtggtctatcaattttgtcgatcatttcaagaagccagctcctggattcattgattttttggaggtttttttttgtctctatctctttcagttctgccctgatcatagttatttcttgccttctgctagcttttgaatttgtttgctcttgcttctctagttcttttaattgtgatgttagggtgtcaattttagatatttcctgctttcttttgtgggcatttagtgccataaatttccctctacacactgctttaaatgtgtcctagagattctggtacattatgtctttgttctcattggcttcaaagacatatttatttctgccttcgtttccttatttgcccagtagtcatgcaggagcaggttgttcagtttccatgtagttgtgcagttttgagtgagtttcttaattctgagttctaatttgattgcactgtggtctgagagacagtttgttgtgatttctgttcttttacatttgctgaggagtgctttacttccaattatgtggtcaattttagaataagtgggatgtggtgctgagaagaatgtatattctgttgatttggggttgaaagttttgtaaatgtctattaggtcttaaacttaaagtataatttaaaaaaagaaagtaaaaagatgataatccacttcatgaaaacacacaaaattatataactcactcatagagccaacagacaaaggagaaagaaaaaagaatcaaactttatcagtatagaaaactaccaaactgtcaaaaataagtaataagagagaaattaaggaataagggttatacaaaataaacagaaaaaataaaagaataagcctttacctataaatacataaataaataccttgaaaataggtggattaaattatacaactcaaaacatagactaatggattaaaaaacaagacccaactatatacagcctaaaagaaactcatctcacctataaagttacacatagactgcaattgaaaagatgaaatagatatgctatgcaaacagaaacccaaatcaagcagaaatagcttcacttacataagcaaaacacaaactttaagccaaaactttaaggagaggaaaagagagacttaatatgataataaatgaatcaattgttcaaaaagacaaaaatgtaaatatatatgcaaacaaccatgaaccattgagatatatgaagcaaatattattatacctgaaaggagagatggacctaagttcaataatatttgaggatgtcaccaccaccttttcagcattggacagatatttagacaaaaaatcaatagaaacacatgagatttatactgtaccatagaccaaatcgaagtaattgacatttacagaacattttatccaacagctgcagaatataagattctttttatagcacatataacatccccagaattaaccatatatgaggacattaagcaagtctcaacaaattttaaaaaataaaaattttactaattattttatctgaacacaatgaaataaagtataaaatcaatgacaagacaaaactagaaaaatccatgaaaatttaacaacgtattccttataaccaataggtaaaaaaagaaacaattttaaaattacttaaaacaagaaaaattacatcatgcgatagcaaaatgtatgagattcaacagaagcactattaagagacaagtttagaacaagaaatgcctacatgaaagaagtagaaaagtttcaaataaacaacctaatgatctctctcaaagaactctaaaaataggaacaaaccaaaaccaaaattagtgtaagtaaagaaatactaaaaattagagagaaaaaatgaaattaagactaaaaaagatgaaacaaaatgctaacttttttaaaagacaaaatcagcaaggcattgactagactaataaagaaaaacaagaaaatatccaatttaataaaatcaaaaacagaacaggaaacttcacaactgatacagaaatacagcacatcattaaagattgtaatcagcaactacacaacaaatttgaaaacctggaagaaatggatacatttcttgacatatacattagactaagataaaaacaacaaaaaatataaatcttgcacagactaatactgaataacaacattaaatcagtaacaaaaagccctccaataaataaaagtccaggactacctggagtcacaactgtattctaccaactttaaattattatgctaactacagaaaccagttacaaaaaacacatcttgtgtgattccatttatatgaagccctcaaaattggaaaatgtatagagacagaaagtagattagaggttgtccagggttgagggataaggagatgctaaggatacgaggttagttaaggatgatgaaataatgtaaaattgaacatcacgatagtcacacaaattctgtgaaaatacaatgagccactgaattgtcttggctttaaattagtaaactgtattatatgtcaaatatatgtcaacaaaacttttacaaaacaaataaacaaacatcccttggaccatgatatctaagaaagtctgattcagctgtgtaagtactttaggcctacgccaagcagactgcagacacaaagcacctcttgctatccactgttcataacatgattctaaactttcttatatcacataggtgatttgtatttgcaagataatcagaacttaaatggggaaaagcatttgtaattgttaaaagagatattaaacacatcatataacacaaggtcatctagatttcactttttccacttgccatgaagatactctgaccattcaaataatgtacttacattgatatgtagtagttatattttaaattcttgacaatctcttctttaatataagcaagataaatggtacagggataaaatttgaaaggaagtaccgcatttaatcaggatgtctatgaaatgaatttcagctctactatagctactgctgagttttttcctcaactctggaagtcgtgaaaaggtgctgatgtagctatggaatacagtcattggatcgatttagaggcaaaactggatgaacttatccagatgaatcatgagatcattgtgagaccatcggcttccatttttcttgatctcagcaaaccatttgctattaccttggaatttaattctatatctttattgaaagaaaacttaaaggattattgtctcagttaataaatataattggtggaaagatatattttagacatttatttcattcatcaaaaaatattttgcaaatattttgtttattttaaaagctctgtcagatgttgttttacaaatagaaaagtatcgcaggcttatggattggaaaaataaatattgtgaaaatgaccatactgcccaaagcaatctacagattcaatgcaatttctattgaattatcaatgtcatttataagataattataaaatataattctaaagtttatatggaaccaaaaaaagaacccagattacaaaggaaatcctgagcaaaaggaacaaagctgatggcataacattacctatcttcaacatatactacaaaactgtagtaaccaaaacagcaaagtactggtataaaagtagacacatagaccaacagaacagaatagagaacccagaaataaagccaaatacttaaaaccaactgttcaacaaagcagacacaaacatgcacaaaggaaaggacactctattcaaaaaattgtgatagaaaaaaaggagagccacatgcagaagcgtgaaactggatgactatctctcatcatatgcaaaaattaactgaaggtggattaaagacttaaatgcagaagaaaatataagaaatactcttttggacattgacctacacaaagaatttatgactaaagacacaaaaagaaaagcaacaaaaccaaaataaagaaatgggactttaaaaagcttctgcacagcaaaagaaataatcaatagagtaaacagacaacgtacagaatgggagaaaatatttacaaactctatatctgacagaggattactaatcagaatcaacaagtaactcaaacaaatcagcaagaagaaacaatcttataaaaaatgggcaaatgacatgaatagacatttctcaaaagaagatatacaaatggtcagcaaatatggaaaaaagctgaacatcagtaaccatcagggaaatgcaaattaaaaccacaatgagatatcacctgactaatggtatactcttatcagaatgattgtattttaaaagtcaaaaaaagtagatattggcgcagatgtggtgaaatgggaacatttaaacactgttggtgggaacataaactagtacaacctctgtgaaaaactgcatggagatttctcaaataactaaaagtaggtaaaatatttgatccagtaatcttactaccagttacctacacaaaggaaaggaagtcattatattaaaaagacatctgcactcatatgtttattgcaacaaacttcacaattccaaagatatggaatcaacctaagtgcccatcgacagatgagtgaataaagaaaatgtgatctatatatcacatggatatacacggccacatctcacaggaaaaattccagatcatccatgggaacttccccttacctcagcgcctttggggactttgaccaaaactaggaaggctgcatcagtagggaaaagatgctttccttttcctgtgcttcagctccttgctgggagtctacatgggttttgtacacagtttccaggagggcaactcctagagtgcagtagcctgctgccactgcgaagccctgatcctgggcatctataagcagggcctcaactgccaagccagtggtatgagctgccaccagcagtgcaaggattgcctgtaagttgagcaccagtgcaggccccagagtgtgggcctggaggagtctccacgtcaccctcacacactcatacccaccatcatcccaccttcagcttctccctgccctgccatggcaaacgagactcccagcctccagagattcatgaggaggagatgcagatggtgaaggatggggtgtttgacaactgcttgtaattgatgctatgattggatcaaggactcattcctgccttggagaaaagacttgaaccagagcagggagcctgggggtgctgggacagaaggttggggctgagggcagaatgtgatggtggcatgcagctaagggcagggccagggcaggcgtccctaaggttgtaccaacttttgtgaatatttgtattttcctcatggaataaaaaggctcatgtaattaatctccatatatatatacatttatatatgtgtatatatacatttatatatatataaatgtatacacacacacacacacacacacagaaagagagtagtatatacatacacagcatacatgcatatatattcccttttttctgggagtttttccactcatttccattcaccaaagcaatgcctttgtgccatgtacgtgaagaaatattcgtctgctctagcaaagacctcatctggcacagaagctgtcagggaaacaactacttggttgaatttgcaggagggaaaaggggagacttctttgagatccctggtttttttaatgaagactttatatggcttaccctgtgagaaatgttaaatttctggacaatccttggctaaccagatctgtatattagtacgttccaagttgttcagcagaacagcagacaaattacttttatttttaatttcaatactctttgctttagaaacaattttgctgtggcacttcctagtctgtgactctgtcttgaaaagggctggaactcaggctgcgtagacatacatatttcatttatctggtcttcaacttaaacattcacctctttataaaaacttctctgtaattctgaaggtaattcccctttttttgatggagttcaaaaattgctgacttgcactgttgggaaatcatcactgactgtgatttcattttccatactttcatatttacatccacctgctttttctgttcagtgggagacaagcagttggagccaaccttctgagcttcttcaaaaaggctatcaacaaaatattcacaatttgttgattatcactgagagattgattgtcagatactgtttcacaaacccatcttcttttatactttcgagattatctacctctttcattctcttttgtcttattctgggcagggtctcctggcctcagcctcactcagctcagaggccacgagcaccctttggccccgggctccgtctggagcccgctgctccagacctccttaggttccgccgcggcacagctaggatcctgacggactctctaggtctctgccaggcaccagacaccaaaagcatgctgatgtagtctcaattgatttgtttttaaattggtaattaaacctccacctttattgaaagatcatttggaagattttgttctcatactcggtcagttaataaacatatgatttgtcaaaagatagattttagaaacattttatgaattcaaaaaatttgagggaaatatttgggttgttttagaagctctgtcaagatgtagttttaatcaagaaacttatgtcaaaagtttaagaatcaagccttaatattattcttgcagatgtccttggtaaaatctgctggtggggataattaaaatacacattgtatatactttgtatttcctttttggccttttttttttttttaatggagtctaactgtcacccaggctggagtgctagagtgcagtggcacaatcttggctcaccacaacctctgccttccagatggaagcaattctcgtgcctcagcctcctgagtagctgggactacaggtgtgccccaccacgcctggctaatttttttgtatttttattaaagatggggtttcaccatgttggccaggctggtcttgaactcctgacctcaggtgatctctctaccttggcctcccaaagtgctgggattacaggtatgagcccctgtgcccagcccagtgtggagcttctattcactcctttctatgtacctgtggttctgtcagaattaagtgatcaaataacataaatggagatggtaaaaaaatgtgataagacatcagaaagatagtgggatagaaagccagcaactcatgtctccccttgcaacaataagaatttttcacacaaccacagataaaagactctttagttttggtattcaggtaggatgttgtgaaacccctgtgtagcccaagacctagcaagggcattttgagaatacataacagaactcaggtattagactcacttataatgccagaaacagccccatttcccaaaaagcttgtctacagccctgtttggccttgagcctgtaatcaaaattatcttcccaggagtccaggaggaatcatactcactagtgccttagcagaaaagcttatctgtccaccaacattggtctcagcagcagaattgacagttatcctgtaactcaggggaaaccccttcagttgtggtgccagattattactgcttgggcaaggacatagaagcagatttacccatgtctttcagtccagtaattacctgttcatctgagtgtgtgacaggcctgtcaatcttcattcaaacacaaattatgaggaagcctagtttcagctctagcccttctggctgcagttggagaactatcctacccacataggaaagtgctgggggttgcttgtccacctgctaatgaggtcggctcaccatcctccttctgcagtaagtccctagggagcccagccccagctccaaccttcctttctgcagtcagggaccttccctgctcgtgcagaaaactattgggaagcacatttgcctgggccaccatccaggctcaccagtctctgctcccagagcatattctgggagtgggaagggcagtctcgactcaaacccctcttgctacattcaaagaactgcttctacttttcaagaaagacaaaagagacaagagacaaaagagcagaaggctattcaaagaaataatagcggaaaactttcataacttggagaagatataaacatccaggtagagttaggtaaaattaaccgataagatacaacataaataagattactctaatatatattataatcaaactctcaaaagtcaaagacaagctgctgaaagcagcaagataaaagaagtaaaatgcatgtaaaggaattacaagacatctggcaacagacttctctggagaaaccttgtcagccatgatagtgtcagacaatacattcagagtacctaaggcaaaacaaaacaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtcctacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaaaagtaataataactacaaaaatttattaagagattggaaatataaaaaatgtaaattgtggcatcgaaaacttaaaatacaagggaatattacagttaaagtatacaggggttttttttgcttctctttcaaatcaaagataattgtattggtttaaaataactttttataagatatttttctctccattccaagatggctgaacaggaacagccccggtctgcaactcacagcatgatggatgcagaagataggtgatttctgcatttccaatggaggtacctcgttaatctctttgggactggatggacagtgggtgcagcccacggagggtgagctgaagtgtaaggggtcagggtgtttccctttcctagcaagggaagctgtgacagactgtacctggaaaaatggggcactcctgcccaaatattgcacttttcccagggtcttagcaactggcagacaaggagattctctcccgtgcctgacttgggggggtcccatgcccatggagccttgctctctgctagcacagcagtctgagatcaaattgtgaggcaacagcctggctgcaggaggggtatccatcattgctgaggcttgagtaggtaaacaaagcagccgagaagcttgaactgggtggagtgcatggaagttcagcaagccctactgcctctagactccacctctgtggacaggacatagctgaacaaaaggcagcagacaacttctgcagacttaaacgtccctgtctgagagctctggagagagcagtagttctcccagcacggagtttgagctctgagaacagacagactgccttctcaagtgggtccctgatccctgtgtagcctaactgagagacatctcccagtaggggccaacagacacctcatgtaggtgggtgtgcctctggtacgaagcttctagacgaaggatcgggcagcaatatttgccgttctgcaatatttgctgttctgcagcctccactggtgatacccaggcaaacggggtctggagtggacctccagcaaactccaacaaacctgcagctgagggacctgtctgttagaaggaaagccaacaaacagaaaggaatagcatcaacatcaacaaagaggacctccacaccaaaaccccatctgtaggtcaccaacatcaaagaccaaaggtagataaaaccacaaagatggggaaaaaccagagcagaaaagctgaaaattctaaaaatcagaatgctacttctcctcaaaagtatcacagctcctcaccagcaacagaacaaagctggacagagaatgactttgacgagttgatagaagtaggcttcagaaggtcgttaataacaaacttctctaagctaaaggagcatgttcaaacccattgcaaggaagctaaaaaccttgaaaaaaaggttagacaaatggatagttagaataaacagtgtagagaagaccttaaatgacctgatggagctgaaaaccatggcacgagaacttcgtgatgcatgcacaaggttcaatagctgaatcaatcaagtggaagaaagggtatcaatgactgaagatcaaatttatgaaataattgtgagaagacaaggtaagagaaaaaagaagaaaaagaaatgaacaaagcctgcaagaaatacaggattgtgtgaagaggccaaatatacattagattggtgtacctgaaagtgatagggagaatggaaccaagttggaaaacactcttcagtttattatccaggagaacttccccaacctagcaaggcaggccaacattcaaattcaagaagtacagagaacaccataaagataatcctcgagaagagcaaacccaaggcacataattgtcaggttcaccaaggttgaaatgcaggaaaaaatgttaagggcagccagagagaaagatcgggttacccacaaagggaagcccatcagactaacagcagctctctcagcagaaactctacaagccagaagagggtgggggtcaatattcaacattcttaaagaaaagaattttcaacccagaatttcatatccagccaaactaagcttcataagtgaaggagaaataaaatcctttacagacaagcaaatactgagagatcttgtcaccaccagaactgccttaaaagagctcctgaaggaagcactaaatatggaaaggaacaactggtactagccactgcaaaaacatgccaaattgtaaagaccattgatgttaggaagaaactgcatcaactaacaggcaaaataaccagctaacatcacaatgacaggatcaaattcacacataacaatattaaccttaaaggtaaattggctaaatgccccagttaaaagacaaagaccggcaaattgaatagagtccagacccatcagtgtgctatattcaggagacccatctcacgtgcagagacacacataggctcaaataaagggttggaggaagatctaacaaccaaacggaaaacaaaaaaaagcaggggttgtaatcctagtctctgataaaacagactttaaatcaacaaagatcaggagacaaagaaagccattacataatgataaagggatcaattcaacaagaagagataactattctaaatatatatgcactgaatacaggagcacccagattcataaggcaagtccttggagacctacaaagagacttaggctcccacacgatagtaaagggagactttaacaccccactgtcaatattagacacatccatgaaacagaaggttaacaaggatatccaggacttgaactcagctctgcaacgagcagacctaatagacatctacagaactctccacccaaaagtcaacagaatatgcattcttcttggaaccacatcacacttgttccaaaactgaccacatagttggaagtaaagccctccacaacaaatgtaaaagaacagaaataacaacaaactgtctctcagaccacagtacactgaaattagaactcaggattaagaaactcactcaaaaccacacaactacatggaaactcaacaacctgctcctgcatgactactgtgtaaataacaaaatgcaggcagaagtaaagatgttctttgacaccaatgagaacaaagacacaatataccataatctctgggacacctttaaagcagtgtgtagaaggaaatttatagtactaaatgcccacaaaagaaagcaagaaaaatctaaaatcaacaccctaacatcacaattaaaagaactagagaagcaagagtaaacacattcaaaagctagcagaaggcaagcaatacctaagattagaacagaactgaaggagatagagacacacaaaaaaacccttcaaaaaaatcaatgaatccaggagctggttttttgaaaagatcaacagcaagtattgtagaacagcaaacattgctgcctgatccttcctctggaagcttcatctcagaggggcacctggctgcatgaggtgtcagttggcccctactcagaagtgtctcccagttaggctacccaggggccagagacccacttgaggaggcagtctgtccatttcagagctcaaacaccatggtgggagaaccactgctctcttcagagctgtcagacagggatgtttaagtctgcagaagcttctgctgccttttgttcagctatgccctgccagcaaaggtggagtctacagaggtaggcaggcctccttgagctgtggtgggctccacccagttcaagcgtcctggctgctttgtttacctactcaagcctcagcaatggcgaatgcccctcccccagccagtctgcctccttgcagttggatcttggactgctgtgctagcagtgagcaaggctccatgggcatgggacccactgagccaggcatgggatgtaatctcctgggtgtgtcatttgctgagaccattggaaaagtgcagtattaaggtgggagtgtcctgattttcctggtagagtctgtcatggcttcccctggctaggaaagggaaatcccccaaccccttgcacctccggggtgaggcgatgccccgcccagcttcagcctgccttccgtgggctgcacccactgtccaaccagtcccagtgagatgaaccaggtacctcagttgaaaatgcagaaatcacccatcttctgcattgatcatgctgggagctgcagaccagagccgttcctgttcagccatcttggttcatcactatagacacgttacaaaggaagatatacaagcagccaacaagcatatgaacaaaaaggtcaatatcactgatcattagggaaatgcaaattgtaaccacagtgagataccactgatcattagataaatgcaaatcaaaaccacagtgagatactatttcacacaagtaagagtggctataattagtcaaaaaatagcagatactggtgaggttgcagagcaaagggaacatttatacactgttggtggaagtataaattagttcaaccattgtggaaagaggtgtggtgattactcaaaaagctaaaagcagaactaccatttgacccagcagtcctattactggatatatgcccaaaggaatatgtatcattctaccataaagacacatgtacatttatgttcattgcagcactgttcacaataggaaagatatggaatcacctaaatgcccatcagtggtagactggataaagaatatatggtacatatacaccatggaatactatgcagccataaaaaagactgagatcatgtactttgcaggcacatggatggagctggagaccatcatccttagcaaactaacacaggaacagaaaaccaaatgctgcatgtactcacttatgaggaggagctaactgatgagaacacatggatgcaaagagacaacagacactggggtctacttgagggtggagggttggggagaagaataggatcagaaaaaataactattgggtcctaggctttgtacctgggtgatgaagtagtctgcacagcaaactcccgtgacaggagatcagctatattagaagcctgcacttttacccctgaacctaaactataagttaaaaaaaaaaaacttaataaagaaacgtaaagtcaaaagttttgtgactattatgtcaaaattatgtgcttatcattttgctgctattccttttttaaaaaatgcatttttttctctctctgtaaaataatggtgttccctttccaatgcaaacatactttcagatcctaatcattggggtaaacattctttttaaaactactgtttacaaaagtaaaaatctgactttgtccatgcagatcatctattgacaagtatttttcaacagcataattttaaccttaagacatcagttttaatagcagtcattacattattattccaggtgattcatgggacacctgagcactctgtataattgaagttatctgtagccacatttaatatgacatgttcaatgtttggtctcacaagctcactgcttagagtcttcttcatccacccaatattgaagtaatgaaatggctgttaatagattcatcactgatctcattctgtgacatctttatcagaataatataaaatcaatgtaagaaattttgtgaaattatgaaaatttagaaaaaaataaatttcatttataaaatctgtgtgctttcattatggttttattctatttatataactcaatgtacatatattatgtttatataaaatctttttatctcattgcatatgtcttttcttccgacacaaaaattgtgatatttttctgttcatcattatgttgcatagtattcaacaatacctgtactatggctgacagtgtaatttaacattttttgataaaacaattgtaatggcatggtacacacattgtatacattttaaatcatttctcaatgtaaaatatttgaattgtctccagtgtttattttatgaatgtctgccacaaatattgaatctgaccatcgtgatttagttgttctctgtatagtttcatatgagtatattatgaagccaatgtctatgtgcatttttataatacttaatacttttccccaagtgtctgattcttttaaaatatgcaaacattatctgagaatctaatgcataatggaaaagcaagcaaatttgtgacaacaattattttatgtaagaaggaattagaggacaggctgcacaactattgacttggattggaacctaccttctgcaaatgaataacaacagctagtattagtatttatcaccattgtactaatagtcattcttgcccttgtcttccttctccacctactctcttcccccttctaatggcaccatcactttcctctattgcgaaaggggaaattttttgagaataaggttagagtgcatagaattttcattggtcctacctctgcctttgtcctttgggaaattaccacatagagcctatgcaattttcattcagcataaacattgggatttaactcgactaagatttcagttttctgttgttgctaataagaaggtagacaaaaagatctcttaagacttatataataaagtagtgaggaatgcttgctttctacttatgtctcaaaagaataacattaaagtaaaatatatgaggttcttttgtttcttcataaggaagatcatcctatatcctggcataattctttgataaatctcagtgtagttttcagatgcaagtggtagacattatttggatcttattatacatgcattgttcattttttttttggtgcttctctgtcaggcagctgtgatgatgagtcccaagtttcccagagatttttactgaggtgtcctataggcgtggcataaggcagaaaacattaaaagggtaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacacttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcgctttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggtgaagaaattcaaaatcccagtacagttgaatgagccacacttcagctttccccattgtctgaaataatgtacattaataaaataaatgtatacatatctttttatacataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaactgaggtacacaaagagaaacaagtttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaactttgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtatttttttttttttttttttttttgagacggagtctcgctctgtcgcccaggccggactgcggactgcagtggcgcaatctcggctcactgcaagctccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattgtatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttgggctaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaaccataagtgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcagttaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcgaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctgaaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgttttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaaggtaagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtataggtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaatggggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttgtgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggttttctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccggttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcattcctctggaagttttgtctcagaggagttcccggccgtgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccacgtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcaccca

SEQ ID NO: 981 - DNA, 376070 bp, Homo sapiens
  misc_feature (80533)..(180532): n is a, c, g, or t
taaggttttatattatttttatttttcttttcttttttttttatggcttggatgacactttattttcagatccaatactagaagttgtttccatgttcacattttccttcctggtttaaaaaaaagagttgtattttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattcagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatctgatacaatttacttagtgtttatttatggcccagcatatggtaaattcaggtaactatttcatataatctttttttttttttttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgtttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtatggtttgtcaaagatcagatggttgtagatgtgtggtgtttttctgaggcctctgttctgttccactggtctatatgtctgtctttgttccagtactatgctggtttggttactgtaaggtgtaaggaagggatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccggttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtctcccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggatttttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaataaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacagtgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaagcaatttcatacttattgttgccaaatactttaaggtgtcaaaatttgacataagggttacaaaactgtaaaccaagcccaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacgtatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggagccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggcgacacgtcttcaaaatagtgtcttcaggttttttttcctccctttccaccatttttcctagtttggagtcactgtaaactaagtcatgctttcatgaagccctacaaattaagctagacaacttaaactccagaagaaaataacagcaaccaatttacatacataatccactttcatacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaagcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgtatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagcggcacccaagtcagcagagcagacaagttttttttttttttctctaaatctacttggctaggtgggtacctccagagcagtggctagtcagactaggacattctttctctgaatggcaccctgaacagaacactaaatagacctattccaatacatgggaagtaaaaacagccagattgcttggtaagacgaagctgcatgatgcatttcaaagttttttcgatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgttttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcagaagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggggtagttttattttattttatttttttctgttcagttcttttagttaggagtcattggagccattacatgactatgagcattgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaagagagagagaaagaggaaaagaaatgtagacccataagtttcctggatatcatatcaaaattgtatactcatctttttgttgctgttgtcccttttgttcaaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttaaagcaattctcctgcctcagtctcctgagtagctgggattacaggcacctgccaccacgcctggctaatttttctgtttttagtagagacaggtttcaccatcttggccagactggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtgccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtcgcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactgaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatatattttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgtatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttatcaacccctcatcgtttcacctatctctgcacattattgagtactcactttaattgtcaatgagtttgggatctcttctgcatatttctttatcattgtggtctttccttataacactttttagacttttctttttcacttgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaatacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctagtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttatgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaataatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgtttctttctgtcatttctcatacttatatctgaggaaaaatcaatcaagttaaaatataactgctaaaatttgaagtaaatacataatactaacagtctgaataggtgcatgccaaggagaccaacaaaagattgatgacctcatatttattttagtgtgtttggtgttcttttatgtttacaattactctagtcaagcaataatttttatgacctagaatatgtaagtaacctgtcttatgtaattattttataatactgttaagaacagtggcaagtgagaggctcctgcctgttcggtgcccttgacatagagagaagaagtaattatacaactcaaacggcattttttaatatcgtggtgcaagtaatgtcttctaaaactttgttgacacataattcatataccatatgactcaccaattagtgtgtacagttcaatgtttcctagtatattcacagaattttacatccactacaataatcagtattatctccaaaagattctatacaatagcctctaaccccccactctgaaattttgcatccatcctaccctaggcaaccactaatctaatttctatctctatagattagcattttctggaccctttaaaaaataaatgagggttttccagtgatcatggcagatgggatgcaggactagattgcagctccagacagagcagcatgcagaggcttgcattgtgaattttagctgcagatcaactgcaagaacagaccagcaattctgagaggatccacacaccctctgcaggaagagtactgctcctgcaggacctgggagacatcccaaacactgtgagtgccccaacaatggaagtgggaaagggtgatccccctctccagaatacacatccccactggagaagctgaagttctgtttgcaggagaagttcctgactttatgtgaagctgagtcaaattagagaaccaagccaagcaaaatacaggggtagaggaagtagcagaaaggcactgggagctctctggatacccaagcggctcattcctgcctggcatcacagggatctatcaggagggtggccagtgatgcagggggttcaaagattctcctcaggacctgaaggcttgaagggatgagtaactcctcccttctcaggcccagccccaagatgcaagaccacttgcatcagcagcgtgtgtcagcaagatagcagaagcaggaagagagccggccagaagacacttaccctggctggaagagatgtacccctgaagatcaagaaataggccatccaggtactacatagcagtcacaacagactgggacacttactgtttacagaggactacaaaacccctgtcccatcctcacttggggctgatgccattttaggcctcagcccacctgcaaccaggcgttcattaaaacagcatgttgctccacaccgcctcctgttgtctgttggcgcgctgttggggttcaaactgattcaagaaccttacatctggtgccaaatcctaggaggggctcaggtctgtgtcgcttgtggacctatccctccaccccagagagcaggccacagcaattagacagaggaagctcctcagcctccagtcgcctctctgtgcatgcgcatcagccactgatctcgcctactggtaagtttcccttggagcccggttaacagggcaaaatctacatggcctctcttggtttctccagtccaaaaatccaacactgatccaagaaggcgccagcgtgcgccaggcactcgctggtcatctggtcttagggggatgcctctaagccatttcatcccgttccaggaaccaaaaaggcagcggagacgataactccttttatcgtctccctccagctgtccaggatggtctcctttttccctgttctctcgagctacccttcattatgggaaactcccggtcctcaattccaaaaaacagccctccagcctgcctcattaaaaatctgcaaaccttaggcctcaggcaagatatctgccataagtgccttgtcttttttatacgataaagcctggtcgcagtatgaattagataacgggtccaaatggcccgcaaatggaacactcagctttacagttttaactgacttaagcagttattgcagatgactgggaaaatggggagaaattccttgtgtccaggcctttttgcactcagatcacagcccgacctctgcaattcttgcttacctgttcaaatccttcttcattctcgccgccctcattgcctttatcctcccgaccctacctctttttcctcattggatggagcagactgctgtccacccctcccagaccctacccctccatctcaaccaacttcattaactccccaagcttcctcattgtcttctcagccaccatcttcccagccaccatcttcccagccagcatcacccacttcttttcctataccatcctctcctcaggaaaactctagcattgcctgtactcattctccttccttacagccctctcacggagcctgtaaacccatcccgccaccttacacccgtatctatcctccaatgcctatcaactcaaccccccttccctcttcaaaccctcagcaggaaccccttctggcttcttccttctctcctgcccatactagctccggcaccatctttggcccatgccccacccgtactttagcgccagtgctagaatgcccccttcgggaagtagcaggaactgaaggtattgttagagttcatgttcccttctccctcactgatctctctcaaactaacaaaagactcagttcatttccagaagatcctacctcttatattagggagattcagtaccttactcagtcttatgaactaacctggcatgacagctacttatcttctcttccaccctcaccccagaagaccagcaccgtacttggaccctagctcaggtgcatgctaatacaattcatcatcaagctcctgcccagcctactggcacagaggcagttcccaaccaggacccccactgggattatcaagacagggcctctggacacagccatcaagacctcatgattatgtgtctccttgcaggactcaaaaagggtgcccataaagtggtaaactatgaaaaactttcagaaatcaccgaaggtcctgacaaaaacccagccctttttctctcttgtttaactgaagccatgagaaaattaccaacctggacccagccagcccagaaggaaccactatttcaaaccttcagttcctcacccaatctaccatgatatttggcgcaagcttcagaaggttgatgacggccctcaaaccccacagtgggaccttcttaatttagccttcaaagtctttaacagttgtgatgaggaaagtaaaagaaaaaaacagtttccaatgcttgcctttaccctgcaggcccacagggccacagctccatacagaagcctcctagcaaaacacctccacctggcgcctgtttcaagtgtggcaatgaaggctactggtccaggccatgcccaaacccagctgtgctcaccaggctgtgccccctctgtggaggactcagtgaaagtcaggctgtgagcggctccagcaaggatcgcctccatccctttccgagctggccaaaacctcctactcggatctcaatggccttgccactaaagactgacagtgccctggaacagatgtcccagcaactaccattgcttcatctgagccaagggtaaccctgatggtggcaggtaggcatgcatgttttttaaaaattaatattggagcaacctactctgctttacctaaattttcaggacccacccagtcctcccaagtctctgttgtgggaatcaatggacaagtctccaaaccccaagacccccctccacttttctgctccctgaacaccttttccttcagtcactctttcttagtcctgccttcatgcccagctccgctcctaggcagagatattctttcaaaactccacactactctccacttccacattccccatagtacccaacacatcaacccagacccctccaaggcttctaacaggcttctaaccttcttctactcctccgacctcccaccctgaaacatgcaacttttccttatcccccacctgtagttaaccccactgtttgggatacttccacaccctcggtcacagagcaccacacccccatccacatcacccttaaagagcccaccccgttcctatcacagaagcagtatctcatcccccaagcagctctcataggcctaaagcctatcatttctctcctcctcaccagtcacctactctgcccaacaaactctccttttaacacatcagttctacctgttaaaaagccagatggaacttatcacttagtccaggacctcaggctcattaaccaagctgtactcccagtgtgtccagtagtttctaacccatatactttactttcctcacttccctcgaataccacccacttttctgttctaaacctaaatgatgctttttcacaattcctttacaccctgattcccaaaacctctttgcctttacctgggaaaaccccgacacccacctttcaggtcagctcacctggtgcgtactacctcaaggttttagagacagcccccacctttttggacaggcccttgctagtaacttctgtactttatccctaaaatcatcctctcttctttaatatgttaataatctgctcctgtgtagcccctctcaaagagactgcaacacccatacatactatctcccttttaaacctcttggcagaacaggggtatcaggtctcccctaagaaagcccaaatatgcaccccccagtcacctatctaggcctagctcttacccctgaatgcaagggctcacaacagaccacatactccctccttcagtccctcccgcctccacaaactaagcaagaaattctctcttttccaggattagcaggatattttaagctctgggtttcctccttcgctctacttaccaaaccgttgtaccaagctgctaaaggccctctccatgagcctttaaaacctgcacagcctattacccaacctttccatctactccaaaagtctctcatctcagcccccatcctcactctcccagacttcaccaaacctttctccctctataccgatgaatggcgtggagttgcactaggtgttctaacccagtctaagggacccacccggccaggttgttgcctacctccctaaacagcttgaagccacagttctcggatggcctgcctgcccctgagcattggtggcagttgctgtcctcactcttaaaagcctaaaactatctcttcatgccaacctaacagtttattcaacccataacatcaaagacatgttagctcaccgcagtgtactaagtcttttctctgccccacggctcctccagctgtatgctctattcatagaaactccccacatcaccatgctaaccacctcccatctaaacccggccatgctcttacccgaagctacaaccgcccaagactcttcttcacactcttatgtgtgaatactgttcaaacctttcttataccttttccaaacctaacagaaaaatcccttccagatgcgtcctttactcggtttgtagatggcagctccttcctacatcaaggacaccgacatgctggctatgctatagtgtcaccccccaacactattgaagtcaatctgctcctcttaggcaccacctcccaaaaggctgaactcattgccctcactcgagctctcattctagcatccggaaaacagatcaatatattcaaattctccttatgtgttccacgtagtgcactcacactcatccatctggaaagaacggggtttcctcactgcaaacaatactgtcataagtggctctctcatcagcaagctccttcaagctgccaggctcccacagaaagttgccatcattcattgcaggggccaccaaaccccagacaatcctaaattggctggaaatgtgctagcagatcaggtagccaaacaagtagccctactaccctttcgaggccagttgctgtccttgtccttgttctctcctctttacttctaagaagaaaaagatttccaagcccaaaaccttcaaaagcaaggacgatattatgtcaaggaagggtgcttagttattcctcactctcaaagccttcctcacctccaaagcctccacaactctttccatgttggttaacaacctcttgcagcttctccacgctattctcacttgtcgtcacttttccagccatgttcaagaaattatccagtcctgctctatctgccactcaatgtaaccccagggatccctccagcctctgccttttcatacccaccaagcccagggccagttacctggggaagattggcaagtagacttcactcatatgctgcatgataaatgtctctgctatcttctaatccttgtctgtactttctctggctagggagaagtgttcccaacaacttcaaaaggtgcaaatatcatcacacaaactcatcatgcatacagttccctgtttcagactcccaacatccatccagtccgataacagtcctgccttcatcagccacattacccgaggcatctctacatccttaagaataagtaagttctccacacaccctacacacctcaatcttcaggcaaagttgaaaaaattaactctgtccttaaagcctaactcatcaagccggctctagaaacctgcgagtcatggacaaaaaaatctcccttttgccctcatgagactttgcacaacaccaaaagcaccctctttttttgtttttgtttttgtttttgttttgttttgttttgtttttattatactttaagttttagggtacatgtgcacaacgtgcaggttagttacatatgcatacatgtgccatgttggtgtgctgcacccattaactcgtcatttaacattaggtatatctcctaatgctattcctcccccctccccccaccccataacagtccccagtgtgtgatgttccccttcctgtgtccatgtgttctcattgttcaattcccacctatgagtgagaacatgtggtgtttggttttttgtccttgcaatactttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgcagcaataaacatacatgtgcatgtgtctttatagcagcatgatttatagtcctttgggtatatacccagtaatgggatggctgggtcaagtggtatttctagttctagatccctgaggaatcgccacactgacttccacaatggttgaactagtttacagtcccaccaacagtgtaaaagtgttcctatttctccacatcctccctggcacctgttgtttcctgacttttaatgattgccattctaactggtgtgagatggtatctcattgtggttttgatttgcaattctctgatggccagtgatgatgagcattttttcatgtgtctgttggctgcataaatgtcttcttttgagaagtgtctgttcatatcctttgcccagtttttgatgcggttgtttgtttttttcttgtaaatttgtttgagttcattgtagattctggatattagccctttgtcagatgagtagattgcaaaaatgttctcccattctgtaggttgcctgttcactctgatggtagtttctgttgctgttcagaagctctttagtttaataagatcccatttgccaattttggcttttgttgccgttgcttttggtgttttagacgtgaagtccttgcccatgcctaatgtcctcaaagtattgcctaggttttcttctagggtttctatggttttaggtcaaacatgtaagtctttaatccatcttgaattaatttttgtataaggtgtaaggaagggatccattttcagctttctacatatggctagccagttttcccagcaccatttattaattagggaatcgtttccccatttgtggtttttgttaagtatgtcaaagttcagatggttgtagatatgtggcattatttctgagggctctgttctgttcccttggtctatatctctgttttggtaccagtaccatgctgttttggttactgtagccttgtagtatagtttgaagtcaagtagtgtgatgcctccagctttgttcttttggcttaggattgacttggcaatgtgggctcttttttggttctatatgaactttaaagtagttttttccaattctgtgaagaaagtcattggtagcttgatggggatggcattgaatctataaattaccttgggcagtatggccattttcatgatattgattcttccttcccatgtgcatggaatgttcttctatttgtttgtatcctcttttatttcattgagcagtggtttgttgttctccttgaaaaggtccttcacatcccttgtaatttggattcctaggtattttattctctttgaagcaattgtgaatgggagttcattcatgatttggctctctttttgtctgttattggtgtataagaatgcttgtgatttttacacattgattttgtatcctcagactttggtgaagttgcctatcagcttaaggagattttgggctgagatgatggggttttctagatatacaattatgtcatctgcaaacagggacaatttgacttcctcttttcctaattgaataccctttatttccttctcctgcctgattgccccggccagaacttccaacactatgttgaataggagtggtgagagagggcatccctttcttgtgccaattttcaaagggaattcttccagtttttgcccattcagtatgatattggctctgggttgctcatagatagctcttagtattttgagatacatcccatcaatacctaattcattgagagtttttagcaagaagcgtcgttgaattttgtcaaaggccttttctgcatctattgagataatcatgtggtttttgtcattggttctgtttacatgctggattaagtttattgatttgcatatgtagaaccagctttgcatcccagggatgaagcccacttgatcatggtggataagctttttgatgtgctgctggattcagtttgccagtattttactgaggatttttccattgatgttcatcagggatattggtctaaattctctttttttttgctgtatctctgcgaggcttcagtattgggatgatgctggcctcataaaatgagctagggaggatttcctctttttctattgattggaatagtttcagaaagaacggtaccagctcctccttgtgcctctggtagaattcggctgtgaatccatctggtcctggactttttttggttggtaagctattaattattgcctcaatttcagagcctgttatcagtctattcagagattcaacttcttcctggtttagtcttgtgagggtgtatgtgttgaggaatttatccatttcttccagattttctagtttatttgcatagaggtgtttacagtattatgtgatggtagtttgtatttctctgggattggtggtgatatccccttaatcattttttattgcatctatttgattcttctctcttttcttctttattagtcttgctaacgatgtattaattttgttgatcctttcaaaaaaccagttcctggatttattgattttttgaaaggtttttgtgtctctatttccttcagttctactctgatcttagttatttcttgctgtctgctagcttttgaatgtgtttgctcttgcttctctagctcttttaattgtaatgttagggtgtcaattttagatctttcctgcttcctcttgtggggatgtagtgctataaatttccctcgacacactgctttgaatgtgtcccagagattctggtatgttgtgtctttgttctcgttggtttcaaagaacatctttatttctgccttcatttcgttatgtacccagtagtcattcaggagcaggttgttcagtttacatgtagttgagtggttttgagtgagtttcttaatcctgagttctagtttgattgcactgtggtctgagagacagtttgttataatttctgttcttttacatttgctgaggagagctttacttccaactatgtagtcaattttggaatagatgtggtgtggcgctgaaaagaatgtatattctgttgatttggggtggagagttctgtaaatgtctatcaggtcaccttggtgcagagctgagttcagttcctggatatccttgttaactttctgccttgttgatctgtctaatgtttacagtcaggtgttaaagtctcctattattattgtgtgggagtctaagtctctttgtaggtctctaaggacttgctttatgaatctgggtgcccttgtattgggtgcatatatatttaggatagttagctcttcttgttgaattgatccctttaccattatgtaatggccttctttgtctcttttgatctttgttgttttaaagtctgttttatcagacactaggattccaacccctgcctttttttgttttccatttgctcggtagatcttcctccatccctttattttgagcctatgtgtgtctctgcacgtcagatgggtttcctgaaaacagcacactgatgggtcttgactctttatccaatttgccagtctgtggagtatttaacccatttacatttatttttaaatgtattggagtatttagcccatttacatttaaagttaatattgttatgtgtgaatttgatcctgtcattatgatgttagctggttattttgctcattagttgatgcagtttcttcctagccatgacggtctttacaatttggcatcttttgcagtggctgctactagttgttcctttccatgtttagtgcttccttcaggagctcttttagggcaggcctggtggtgacaaaatctctcagtatttgcttgtctgtaaaggattttatttctccttcacttatgaagcttagtttggcgggatatgaaattctggattgaaaattcttttctttaagaatgttgaatactggcccccactctcttctggcttgtagagtttctgtggagagatctgctgttagtctgatgggcttccctttgtgggtaacccgacctttctctctggctgcccttaacattttttccttcatttcaacattggtgaatctgacaattatgtgtcttggagttgctcttctcgatgagtatctttgtgttgttctctgtatttcccgaatttgaatattggcctgcattgctagattggggaagttctcctggataatatcctgcagagtgttttccaagttacttccattctccccgtcactttcaggttcaccaatcagatgtagatttggtcttttcacagagtcccatatttcttggaggctttgttcatttctttttattattttttctctaaacttctcttctcatttcatttcattcatttgatcttccatcactgataccctttcttccagttgattgaattggctactgatgcttgtgtattcatcaagtagtctcatcctgtggttttcagctccatcaagtcctttaaggacttctctgcactggttgctctagttagccatttgtctaattttttttcaaggtttttaacttctttgccatgggtttgaatttcctcctttagcttggagtagtttgatcatctgaagccttcttctctcaactcatcaaagtcattctccatccagctttgttccatttctggtgaggagctgcattcctttggaggaggagaggtgctctgatttttagaatttccagtttttctactctttttttttccctatctttgtggttttatctacctttggtctttgatgatggtgatgtacagatggggttttggtgtggatgtcctttctgtttgttggttttccttctaacagttaggaccctcagctgcaggtatgttggagtttgctggaggtccgctccagaccctgtttgccttggtatcagcagtggatgctgcagaacagcggatattggtgaacagcaaatgttgctgtctgattgttcctctggaagttttgtctcagaggagtacccggccatgtgaggtgtcagtctgcccctacaggggagtgcctcccatttaggctactcagttgtcagagacccactggaggaggcagtctgtcctttctcagatctgcagctgcatgctgggagaaccaatactctcttcaaggccatcagacagggacacttaagtctgcagaggtttctgcttccttttatttggctatgctttgttcccagaggtggagtctacagaagcaagcaggcatccttgagttgcagttggctccacccagttcgagcttcccagctgctttgtttacctactcaagcctcagcaatgtcaggcacccctcccccagcctcgctgccaccttgcagtttgatctcagactgctgtgctaggtatgagtggggctctgtgggcataggaccctctgagccaggcatgggatgtaatctcctggtgtgccgttcactaagactgttggaaaagcgcagtattatattaagagtgacctgattttccaggtgccatctgtcaccgctttctttgattagaaaagggaattccctgaccccttgcacttcctgggtgaggcaatgcctcaccctgctttggctcatgctcggtgcactgtacccactgtcctgcacccactgtctgacactccccagtgagatgaacctggtacctcagttggaaatgcagaaatcacccatcttctgcatcactcatgctgagagctgtagactggagctgttcctattcggcctagctaattattaatatttcttttcttatagtaattttggttttggtttgttcttgcttttctagtcatttgagatagatcattacattttttatatgaaacctttctccttttcttgtgtaggcatttcttgttctaaacttgtctcttaatagtgcttctgttgaatctcacagattttgctattgcatgatgtgatctttctttgttttaagcaatttcaaaattgtttcttttttatctattggttataaggaatatgttgttaaattttcatggatttttctagttttgtcttggcattgattttataatttatttcattgtgttcagataaaataattagtaaaatttttattttttaaaatttgttgagacttgcttaatgtcctcatatatggttaattctggggatgttatatgtgctataaaaagaatcttacattctgcagctgttggttaaaatgttctgtaaatatcaactacttcaatttggtctatggtacagtttaaatctcatgttgctttattgtctaaatatctgtccaatgctgaaaaggtgatggtgacatcctcaactattattggacttaggtctatctctcctttcaggtataataatatttgcttcatatatctcagcggttcatggttggttgcatatatatttacatttttgtctttttgaacaattgattcatttattatcatattaagtctctcttttcctctcaaaattttggcttaaagtttgtgttttgctgaggtaagtgtagctatttctgcttgatttgggtttctgtttgcatagcatatctatttcatcttttcaattgcagtctatgtgtaactttattggtgagatgagtatcttttaggctgaatattgttgagtcttgttttttaatccatcaatctacgttttcagttgtgtaatttaatccacttattttcaaggtatttatttatttataggtaaaggcttattcttttatttttttctgtttattttgtatctcccttattccttaatttctctattacttattttgacagtttgatagttttctatactgataaagtttgattattttttctttcacctttgtctgttggctgtatgagtgagttatataattttgtgtgtttttatgaagtgtattatcatcttttcaccttcagatgttagacttcctcaaatattccttttaaggctggtttaatggtaataaattctttatgtttttgcttgtttgagaaatactttattcctctgtctctgttttttttgtaggatcaaagtttgctttatataatattcttcattgacatgattataaaacaaattttatcacttagcatatattttcctattctttcctggcctataagttaatgctgagaaatccactattagctgaatggagattcccttatagatgatgtgtcagctttcttctgccatttttagaacacctgctttgcatttgacttgataatttgacgatatgtgcatcagtgaagacctttttggattgaagtaacttggtggaactttcagcttcttggatctagatgttcatcttttgtcaataacttaagaagctttctgctattatttcattgaatataatttctatgctgtttatcttctcattctagaattttcatcatgttaattttttttcttttttacttagtgatgttgcataaattctgtaggattactttattctttttcttctttcttgtctatgtgagtcatttcaaaaacatggtaatagttggaaattatttcctctgctttgtctcttatgttcttgaagctctcaatagtatatttttaaaaaaatttgttcattgctttaaagtattttatatttttgtgggtacatagttggtggatatgcttacggggtacatgagatattttgatccaagcatgttctagtgaaaaatttttacaatgaacaattcaataaagttgcagaacatgaaattaacagacaaaatcaataacatttctatttgcctacaatgagcagctgaaaaagaaatcaaaaaagtattcccatttacaatagtcacaaataaaattgaacatctaggaattaaaggactgaaagatctctataatgaaaactactgatgtaagaaattaacactgatgtaagaaaacactgatgtaagaaattagagggtaccaagaaatgaaaaaatattccatgttcattgattagatgaataaatattgttaacatttctatattaagcaaaacaatctactgatgcaataaaatcatgaaaataccaattacattcttcacagaaatagaaaaaaatctcaaaatgtatatgaaaccggaaaagacccagaatagtcaaaggtatcctaagcaaaagaaaccaacttggagtcacattatctgacttcatattacactacgcacctatagtaaccaaaccagcatgttactgccataaaaacagacacagagatcaatgaaacagaatagagaacccagaaaacaatctacacacctgcagtgaactcattttcatcaaagttgccattaacatacacagaaaaaaagacagtctctttaataaatggtgctgggaaaacagaatatctatatgcagaagaatgaaactagatccctagctctatccatatacaaaaatcaaataaaaatggtttaaaggcttatatctcagacctcaaattatgaactactacaagaaaacattaaagaaaatctccaggatgtttttctgggccaaaatttcttgggttataccccataatcacaggcaaagtaaaaatgaacaaatgagatcacatcaagttaatcagcttctattcagcaaaggaaacaatcaacaagtgaagagacagtccacagaatgggaaaaatatttacaaactatccatctgacaaggaattaataaccagaatatataaggggctcaaaccctctataggaaaagataaaaaaatggacaaagaatttgaatagagatgtttctcaaaagtaaacagaaaagtggcaaacagacatgtgaaaagatgctcaatatcactgatcatcagagaaagtcaaatcacaactaaaatgagacatcttctcacaccatttaaagtagcttatacccaaaagacagacaaaaataaatgctgatggggatgtgaagaaaaaggaaccctatacaattttggtgggagtgaaaattagtaaagaccactatggagaacagttgacggttcctcaaaaaaatgaaaaatagagctaccatatgatccagcaatctcattgctagatatatacccaaaagaaataaatcagtatgtcaaagagatacccgcactcccatgtttgttgcactatttacaatagctaagatttagaattagcgtgaatgtccatcaacaaatgaatgaagaacatgtgttgcatagacacaatggagtaccattcagccatgaaaaagaatgagatccattcattttcaacaacatggatggaactggagctcattgtgctaagtgaaataagccaggcacagaaagacaaacatggtatgttatcacttatttgtgggatctaaaacttaattaaactaatgaacatagaaagtagaaggctgattacttgagcctgggaagggtactgggggcatgggggtaagcagggattttaacaggtacgtaaaaaggaataagacatactatttgatcacacaacagggtgactatagtcaataataacttcactgtacatttttaaataactaaaatagtgtaattatattgtgcataagacaaagtaaaaatgcttgaggggatagatactccattctccataatatgcttatttccaattgcatccctgtatcaaagtatctcatgtactccacaaatatatacatttactaggtaaccacaaaaatttttaaaaattgaaaatttaaaaatttgaaagatatacttaatggaaaaacaagcaatttgtaatacaattattttatgtaataaacaattaggggacaggtttcaaaaactattgacttggatttagtaacaacagtaagtattagcaattatcatgattgtactattagtcattctttcacttgtcctacttccctaccaactcttccgtttcctggtggcactattaatttcccttaatgtacatgggaaaattattaaaatataaagttagattgctttgaatttttattagtatttcatcaacttttatctcacgagaaagttaccatgtagaccttatataatttgcattcaacatggatattatgttttagccattgaataagattttagttgtatgttgatgctaataagaaggtaaacagaaatgatcccctaagagactgtataataatgttgcaaagaataattgctatctatatatatcttaaaagtgtgatattaatttaaaacacatgagattcttgtgttctctcataaggaatattctatagaataaataattgttattatgaactaagggcacttttcagatacaagtggtagaaattatttggtttttattaggcaagcacttttcatttttttcttggattctctgagatgcaggtatgacgttgagacataagttgccccagggagctttcctgagttgtcctgcaggcttggcataaggtggaaaaacacctgttcttatagggtaaaatgacctttttttgctgtaacatgtagacctctggaatctcagggatgaatggtttaaatgctggagtgaaagcaagtaaacactgggttttgttgcaaatattttgggggcacaatttctttttatgttgaagaatggtgtacattttaagctagaatactggtgaagagccccaatccttacaatacatcattagcatttcaccttgctcatctgtttgcaaaaacttctgcttctgcttttaaacaagtccacaggatatctgtcatctataacattgctagagaatgtaatgttgatgtgctagatgataatcagtatctattaaatgaggaatgatatctcaggtgactggcatatgataggtaattaatgttattggaaataacaaaaataaccaaaattgcaatattaatatttctggatcactgacttagtgccagacacattttaagtgttttacctgctttaacttttttccacaatacaatataaagctggcaaaagtacacataaatatctctatcaacatgctggtatatttttctatcatttgctgcctgattttattaaaaaaattctaaattgtgtattctttttattctgaccctctgcagtctaattcattgaatatcttggaaactttttaaaggaaggaaatataatcagatctctccatttgttaactctttttagtagcttcccaatgccataataaatatttcaagatcctaataattatttggctccaacttgcctcttcagaatcatctgtttcttagtattcttctgcaaactaaacttgaagacttgagaactgtctttactactttgcctgcttttccttttgtgtcttcctctccccctcattcatcacctatttcttcacacctttcagttctcatcttgattatccatgtctccagtatactttctgttatcccaactggatatatccttgttattgtggtactgaagataatgcttttcacacattttattacttgcttatattttatctttcaacatagagtttaaggaatgtggggacagaaactatgtctacttttcttgtcttcttaaaatccaaagcagtggtttgtgtgaagcactttataagaagtattgtttggttgaataactaatactttcttatatgttgcaaaatgaaggctttaatttgaacattactaggttcagatagtctctagtagtactcttttttctgtagtaataatgaaattcatataattgtgatgatatagaaataggaatctttaattggcatctggtttaccccacccactaaacatctttctttcacttcaagcaaaaacactgaaagaagaatatagtatcattcccaccaaaaatttaagacaaacaaaacaaaacaaaacaaaacaaacaggtttttttttttttttttttttttttttttttacctttggcagggattttgcaggtttgccgtgaagttttccaacaaagtgaacattttgtaagtgtgggtgaggaaattaaaaattcctgtagttttgaagaagctttgtttcacttttctccattatctcagataatgtagtattttttcataatgggaaaaaggaaaacaaaggcatatgacacaagataattgttatgagaatacaactgataattatctgaaaggagttagaataatgtagccaaagatatataaattgtctatgcttagataaaacaatatacatgtatttatacctggggataatttagtttttgtgcattatctattttgctcatatgtatttacaagaaagaccaagtgctaagagaattgtgggagaaaacttattcttctatcacatcagtgtattcgccatcgtaaaccataattaaaataaaccttagagaataaaacatgcatttgtttactctataaagcagcaatagtaatagatatacacttaaaacaagtctttgaggtccatgatcaatggattctactctactcataaaaaacaattttctaagaagtactcaatttttttcaaaaattaagctagtcccttgatcttttgttcttcaagtgaactgttgagtattttgtgagtatggctgaaatccttgtacctactactgctttgggttcatgctaaggtcttaataatgttagattttaagtaaacatattgtcaaatagcagctgaaattttttcagaaattattgaaatagagacttttgcctaacatggatttcactcatattgttcttagtgaagagacatagttaaaaaaaaaactatacagaagtaacttgatgttcacatttcaacagatgtttgactttaagacaaatgattttcaatcctttagtgaaggagtataaagatactagaaacttcaaattacctgcattgatttttgagtctttgatagagaaattgtatcgttcaattgtgaaggaaacattatggtactgtgggaaaatattttaatttctaaataagggacctgagatacacaattcaaaacaatcccctcaatgctaactagatagttgtgctagaaaaatgcataactcctcaatctacatgtctgcattcagcaggatgtttcttgatgtgtctaatgacttttcttaaatgaaaaatatgtcaagtaaaatggatgtgtgattgctgaaagaaatcctaatgacattaatttataggtttatgagttcctggagtgtgctgtattagtgatgaccacagggttctaacagatgctataatgtaagtctttccataatatttgtgagattgatagattattttatattttcatttcctcatttcttttattgaaaaacagtacttctctgactttatacgtacttaccttctgttttagttaattttcacactgttgacaaagacatactcaagatgggataaaaagaagtttgaaggactcacagttccacgtggctgggaaggcatcacaatcatggtggaatgcaaagagcaagccacgtcttacatggatggcagcaggcaaagagagagaacttgtgcagggaaactaccccttataaaaccatcagctattgtcagacttattcactatcatgagaacagcacaggaaagacctgcctccatgattcaattacctcttactaggaccctctcacagcacatgggaatacaagatgagatgtgggtggggacacagtcaagccatgtcattctgcccctggcccctcccaaatctcatgtccccacatttcaaaaccaatcatgccttacagacagtcctccaaagtcttaactaatttcagtattaactcagaggtccacagcccaaagtctcatctgagatgagacaagtgtcttctgcctatgaacctgtagaatcaaaagcaagttagttaattcccagatacaatgagggtaccagcattggataaatacagatatttcaaatgggagaaattggctaaaatgaaggggctacaggccccatgcatgccagaaatccaacagggcagtcattaagccttaaaattacaaaatgatcttttttgacttcatgtctcacatccaggtcacactgatgcaagaggtgggtttccatggccttgggcagctccacacctgtggctttgcagggtgcagcctccctcccagctgctttaaagggctggcattgagtgtctttagcttttccaggtgcatggtgcaagttgttggtggatctaccactcaggtgtctggaggatggtggcccttttctcacagctcctttaggcagtgtctgagaagcaactcagtgggagttccaactccacattttccttcttgaagtccctaggctacacagaatactgggacgatttttttctttctagcccaccaggcctgtgatggaaggggctgccgtgaaggcctgacatgctctgaagacatttcccccattgtcttggtgattaacatttggctcctcattacttatgcaaatttctgcagccagcttgaatttttcctcagaagaagttaactcttatggtttaatgtaaacacagtatattaaaagtctaagtatgtgcatggcaaagagacaaacaacttgctctttacttgagtctttaatgtcccttttatgtttgtaaatgctattatccaggtagtatcaataattttgtgtggatgagtcacttattttatgtaatatattttacaatagtgtcaagaacattcacagtgagaagttcctttagttctgcaatcactttgagatggaattaaagatgaaaataattatatgagtatatcagcatttcttggatattgtgcttcaaggaattttttggtaaaagttgacatataattgctatgctatacaatttactgattattttgtaaaatccattatttgtggtatattcacagaattgtacatccatgacaacaatcagtttcagagcacttttatttgtatcacaaaataaaccctgtactctttagtattttttcctcaccctgagtttctgcatttctcctgccctgctcaattgctaattaaatttgtatctatagatttgcctattctggaaattttaaaataaatataatcgtacaatatatagtttcttgtgactggcttccttcatttagcataacattttaaaggttcatttatgatgtagcatatgtaaggacttcattcctttttaatggcaaaataaacattttatatatgagcatacacattttatcgatttatttatcagttgatggacattaatttttccctatttttggctagtatgaataatgatgcttatgaacaagcttagtgtaactgtgttttcatttctgtcagatacatattcttagaagtagaattgctgtgttgtgtttccttgcatgtttagctataaaaggttaaactgtacgtgtaaacttttgagaaattgctagactgttttccaatgtggttgcaccattttccattcccatcagcaatgtgtaagtgttacaatgtctccacatcgttttcaacaaatgattatgtgtctttttattacagctaggctggtgggttgaagtagtgtcttgtggggaaaagaaagagagatcagactgttactgtgtctatgtagaaagaagtagacataagagactccattttgttctgtactaagaaaaaatcttctgccttgagatgcagttaatcgataacactagccccaaccctgtgctggcagagacacgtgctgtgttgactcaaggtttaatggatttagggctatgcagtatgtgctttgttaaacaagtgcttgaaggcaatatgtttgttagaagtcatcaccactctctaatctcaagtacccaggcacacaatacactgcggaaggccacagggacctctgcttaggaaagccaggtattgtaaaaggtttctccccatgcgatagcctgagatatggcctcgtgggaagggaaagacctgaccgtcccccagcccaacacccgtaaagggtctgtgctgaggaggattagtaaaagaggaaggcctctttgcagttgagataagaggaagtcatctgtctcctgctaatccctgggcaatggaatgtctcattgtaaaacccgattgcatgttccatttactaagataggagaaaaccaccttagggctggaggtaagacatgctggtgacaatactgctctttaatgcaccgagatgtttatgtatgtgcacatcaaagcacagcaccttttcttaaccttgtttatgacacagagacatttgttcacatgttttcctgctgaccctctccccactataaccctattgtcctgccacatccccctctcgagatagtagagataatgatcaaaaaatactgagggaactcagagaccagtgccagtgtgggtcctctgtatgctaagtgccggtccccagggcccacttttctttctctatactttgtctctctgtctctttcttttctcagtctcttggcccacctgacaagaaacacccacaggtgtggaggggctggcccccttcagtatctcattgttgattatatttccttggtgtctaatgatgttgaacattttgactttgcttataagccactgtattttttttcttttttggagaaatttctattcacatccattgcccatttttaattaatttctttttcttattaagttgtaagtcgtatttctgatacaagtacttcattagttatatcatttgaaaatagattctaagattatgtgggcttttgttttcttgatgctgtcctttgaagcacaaaagtactaaatttgataaagacctatttatatatttttcatatttgattgcttatgcttttgatgtcatatgtaagaaaccactgccaaattcaaagccatgaagattatcttctgtgtgttctttttggaattttatgattctacctcttaaatttaagcctttgacctacttttagtagttttgtaaatggcttgagaccagaagtcaaactttattcttttgtttgtgggcaatccgttattcaataagcatttgttcaagactgttcaattttttcattgaattgttttggcatctttgtaaaaaaccataaatatgtgggtatgtttctgggttctaaaatctattttgtttgtatatatgtctatttgtatgcctataccaggctcatttgattattatagatttgtagttggctttgaaagaagaaagtgtaaatcttccaactttgttattattattattattattttcagacaggatcttactctgtttcccaggctgaagtagagtggtgtgatcatggctcactgcagccttgaactcccaggctcaagcaatcctatcaccttagcctactgagttgctaggaccacaggcatgtgtcacctctcctggctaatatattattattagtattataaagacaagagtctccttatgttgcccaggctggtcttaaactcctttgctcaagtgatctacctgccttggcatcacaaagtacaactttgttctttattttaagacttttttggctatctttaggtttcttgaatatctttgtgaatttcagaattagtttgtcaatttactggaagaagccagttgggattttgatagggattgcattaaatctgtatatctatttggggagtggagtatggacactacaacaatactgtgttttaatctgtgaacatgagatgtctttccatttatttacatcttttaaatttctttcctctatgctttacagtatccataatgcaagttttacacttattttgttaaaattgattcctaatagttatattcttttggatgttatttgaagtgcaattgttttcttaatttcattttggatatttcattgcaattatgtaaagtaatttttttgtttattgatcttttatcctgaaaatttgctttgtttattgttccaatattttttctagcagattcctaaagattttctagatgtaaggtcatgtcatatgccaaaagtttaacttctttcttttcaatgtagatttatttttttcattttcttgcctttatcttgactagaagctccattaaaatattcaatatagataaagagtggatttagtctttctccattaagtatgatgttagctgtgcattttttacagataacacttaccagtttgagaaagtttccctctatccctactttacggggtactgttataatgaaggatattgaattttattaaattaatttttctgcatttattgagatgatcatgcagttttatttttctgttctaattacattttgtattatgttaatagagattttaacgttaaagcaactttgcatttttaataaaacttttacttattcagggtatataattgcttctgtatattcttacattcattttgctagcaaattttgtggatttctgagttcataatcataagatttatcgatctgtagtttttattttttgtgatatctttgtgtggttttactagaaggaattagttaaatatgttgataatgcatttttcttttctgtgatttgaaggattatttttgaggaattgttaatttttctgctttaaatgacttatagatttcaaaataaaggcatcttgacctaggcaattctttgtgggttgtattttggaccaattcagcctctctttttgttataggtctattcagatgttctgtttctttttgaatcagtttaatatattttcttgtctgtgtcttcctgtagtagaatttatgtcaaattaagttgggagtgggtgagggagcagttcatggttgaaattaataggctctcattatttttaccaggacttagtagattttcttgaataaatattgctaatattacgctttataattttaggtcaatgcctggacactttaattttttatagaaaacacaatattttaatgctaaagatgtgtttaaattgtttcttttttacaattgtgatgttctatgaagatttaaacttttgactgttaacagatgatttaaatagaaatgtagcatatgtactcagtgtacatgtgtatattcagcttgtcagcattgagttatctttcataaacttatatttatttatttgacacaaccaggtgggaggggttcccagagaaacaccagagagcctgtgcactgggaggagtgcacactggggtggagccacagaagttcatatgatttgcagtgaggaggagcccggcccctcctcttcttggatggaacctggaattcagtctgtgaggtggcaaacccaccggcaggaaaacacactctctcacttcactaagagcctctgttttgccttttcttcctttttacctaacaaaactctgcattattcaccttcaaagtccgtgtgcctaatttttcatggccatgtgacaagaaccttgcttttagttgaactaagaaaaagtcccacaacatatagatacacacacacgcacacacacacacaggcaaaaatgcaaaaacattcctcattttattttgttttacagatatggtcttttttacaaattgaaagcttattgctgccctgcattgggcaagtttaccagtgccatctttccaacaggatgtgctaactctgtcactgtggcacattttggtaaatttcacaaagttccaaacatttttattattattatatttattatgatgagttgtgataactgattgttgattttactgtagtattgtgttgcgggcaccagaaactgtattgggataatacgataaacttaactgataagtgctggtgtcttctgactgctctaccaaccagcctttcccccatttctctctctctccttaggcctctctatttcccgaggcacagcaatgttgaaatcaggcaaattagtaatcctacaaatggcctctaaatgttcaagggaaaggaaggctctgtcatctcaatatcaaaagctggaaatgattaaacttattaagaaaggcatgttgaaagctgatacaggctcagatctgtacctcttatgccaaatagttagccaagttgtgaatataaaaaaaaaatttgggaaagacattaaaagtgctacacatgtacacatgaatgatatgaaagtgcaacagccttgttggctggataaaagatcaaaccagtgacaatagtccccaaatttagacaaagcctaaaccagaacaaggccataattctctccaatgctgacaggggtgaagaagaaatctttgaatctagcagtggttggttcacgaagtttaagggaataaaccatctccataacataaaagtgcaaaataaaagaagctacagaagattatccagaagatgtagccaaaatagttactgaaagtggccacactaaacaggagatttttccttgtgtacagagcatctttctcttgaaagaagataacatttagcttttttatatcttcacaggagaagtcaatgtctagcttcaatgcttcaaaggacaggatgactctttcattagaggctaatgcagctggtggcttgaagttgaagccaattttttttttttttttagatggagtcttgctctgtcacccaggctggagtgcagtggcaccatctcagttcagtgcaagctccacctcccaggttcatgccattctcctgcctcagcctcccgagtagctgagactacaggcaaccgccaccacgcctggctaattttttgtatttttagtagagacggggtttcactgtggtcttgatctcctgacttcatgatccacccacctcggcctcccaaagtggtgggattacaggcatgagccaccgcacccggttgaagtcactgtttatttaccatttggaatatcctagggccttagataaattattctaaatctactctctctgtgctctattaatggaatatcaaagcttggttgataacacatttctttacagcataaattactaaatattttaatcccactgttgagatctattgaccagaaagaaatattcctttagaaatattagcattcattgacaatgtacctggtcacccaagagctcttatggagatatacagggagatcaatgttgtttttatgcctggtaatacaacattcattctgtaacacatatatcaaaaagtaatttcaacttttaagtcaattaaggaataagtttcgtaagattattgctgccattaacagcaatttctctgttggacgttgtcaaagtaaattcaacactttctggaaaagtttcacctttctagatgatattaagaacatttgagtcattaaatgaagtaaacatatcaacattaacaggaatttggcagaatttgatttcaaatatcatagataatgttgagagcttcaagaattcaatggaagaagtaaccacagatatggtagaaatagtaagggaactattactggaattaaaagaagaacctgaagttgtgactgaattgctataatctcatgataaaacttgaatagatgagttctttcttatggatcagcaaaaaaatttggtatagtgagatagaacctactcctggtgaagatgctgtgaacattgttgaaatgacaacaaagtatttagaatattacttaaggttatttgataaagcagcagtagggtttaagtggattgattccaactttaaaagaagttctatcatgagtaaaatgctaccaaattgcattgcatgctgcagataaatccaagtcaaaatcacaatgagatgctaactcaagccagtcagaatggctatttttaataagtcaaaaacaacagatgctggtgagattgtggagaaaaaggaacacttttacactgttggtgagagtttaaatttgttcaaccattgtgaaagacagtgtggtgattcctgaaagacctagaggcagaaatataatttttcccagcaatcccattactaggtgtatacccaaagtaacataaattgttctattataaagacacatgcatgcatatgttcgttgtggcaatattcacaatagcaaagacatggactcaacctaaatgcccatcaatgacagactggacaaagaaaatgtggtacatattctccttggaatactatgcatccctaaaaaagaatgagatcatatcctttgcagggacatggttggagttggaggctgttattcatagcaaaataatgcagaaacagataaccaaataccacatgtcctaacttatatgtgatagctaaataatgagaagatatggatacatggggggtaaaaacacacagtggggacttttggaggtcaggggatgcgaggagggagaggatcagaaagaatagctaatggattctaggcttaatacctgggtaatgggatgatctgtgcagcaaaccacgatggcacacgtttaccttgtaacaaacctggacatcctgcacatgtaccttgaactttaaataaaagttggaaatttttaaagaaggaaggtcaatgggtgcagcaaacattatttttgtctttttaaaagacattgccacagctccccaaactttcagcagccaccaccctgattagttagcagctgtcatcatcaatgcaagaccctccacctacaaaatgattacaactcactgcaggctcagatgattgttaggatttttaaagcaatgaagtattttcattacagtgtgtacattatttgtaacatatttatattgcagacttaagagactacagtatagtgtacacataacatctatatgccatggaaaaccagaaaattttgtttgacttactttacttcagtgttctgggaccaaatctgcaatatcttggaagtatgtcttgtataagtgaaaataaaatgagatctactcttttaaaagtattttaagtgtatgatacattattgttaactatggccacaatgttgtgcagcagtgctctgaaacctgctcatcttatttttactggaactttatactcattgaaaagcaactctcaatttcctccattctccagccactggtaacctccattctactctccgtttctttgagtttgactgtttcaaatttcttacacaagtagaatcatagagtatgtgtcccattgagactggcttatttcacttaaaattatttcctgaaggttcatctatgttgttacatattgcaggatgggtggatcatatggaagttctatttttaattttttgagcaacctctacactgttttcattttggctgtaaaaatttatattcacactgacagtgtatgaaagtttcaatttctccatttcctagccaacaacttttattgtgtgtgtatatatgtatgtgtgtgtttgtgtctgtatgttgataaagacatggtaagaggtatgaggtgatatctcattgcagttttgattttcctgatgatgaatttacattaattagttttcatacagctgttgtccatatgtacaacttcctcagagaaatgtctttttcaagtatttgcctatttattaatcatggctttttttctctttttgctattgagttgttgcagttcctaatatattttaggtgttaacctctcatgagatatatgatttgaaactgtttcccattcccattttatcttttcactctgttgacttctttgccctgcagaaactttttagtttgatacaattctactttcatatatttgaccttgttacctgtacttctgaggtcatacccaatagaccattgcccagcccaatgtcataaaactttttccgtgttttattgtgagagttttatagtttcagggcttatgtttaagtctttcatttgttttgtgttgatttttgtatatgacataaactaagggtccaattttattcttttgcatgtggacatctggtgttctcatgcagtaccgtttcttgaagagagtgacatttattgagtatatttgagactcattgaatataagtgcattgtatatttgtgactttatcatctgggctctctattctgttacttaaatctctctctatttatgtctttatgtgaatatcatgttattttaataactgtagcttttaatatattttgaaataaggagatgtgatgccctataactgtgttttacttttcccacattgttttggctagttacttcttcctggatcattatacattttaagatttttttgtctttgtataagtcattggtgtttcgatagagattacatttaatatgttaatcactttaggttgtatagatgtttctgtaacattaaatcttccggtcaatatactatgtctttctaaattagtataatctttaatttcattcatcagtgttttgtagtttttagtatacatgtctttcttccacttgttacagtttattcttatgtattttgtcctttttgaggccattgcaaattggagtgttttgttaatttccttttctgatagttctttgttaatacacagaaaggtaagtgatttttgtatgctgattttatatgctgcaaatttactgaatttatgcacttgttctaataatatttggtggcatctttagggttttccacatataatatcatgtcctctgcaaacagaggttattttactgttgattcagaagcctgttgctttttttctttttcttgcctaattgttccggctaggatttccagtatggtgtataatagaagcagcaagagtgaacatcctttccttattgtgaaaacagatgaaaagttttcagtttttttttaatcattgagtatgatgttagctatgagcttttcatatattgcctttatcaggttaagataatttccttctatttcttgttgcaggaagtcagggaccctgaatggagggactggctggagctgaggcagaacatcataaattgtgaagatttcatggacatttatctgttccaaaaattaatacttttataatttcttatgcctgtctttactgcaatctctgaacataaattgtgaagatttcatggacatttatcacttccctaataatactattataatttcttacgcttgtctttactttaatctcttagtcctgttgtcttcataagttgagaatgtatgtcacctcaggaccactattgtacaaattggttgtagaacatgtgtgtttgaacaatatgacatctgtttgtaaaacatatatgtttgaacaatatgaaatcagtgtaccctgaaaaacaacagaataacagcaattttcagggaacaagggaagataaccataaggtctgactgcctgaggggttgggcagaataagccatatgtttcttcttgcagaaagcctataaatggatgtgcaaggaggagaaataccgctgaattcttttcccagcaaggagtaaccctggggaaggaatgcattcctggggagaggtctatgaatggccactctgggagtgtctgtcttatgcggttgagaaaaggactgaaatatgccctggtctcctgcagtaccctcaggcttactaggattgggaaattccagcctggtaaattctagctagactagttctctgctctcaaaccctgtttcctgttaagatgtttataaaaacaatatgggaacagcaggacatagagcctcatcagtaattctaattctgcctttgccttgtgatctatatggccctttgaagcatgtgatccttgtgacctactccctgtttatacaccccctcctcttttaaaatccctaataaaaacttgctggttttgcagctcagggtcgtctgcacagtcctaccaatatgcgatgtcaaccctggaggcccagctgtaaaatttctctctttttactcttactctttatttctcagaccagtcaccaattagggaaaatagaaaagacctacattgaaatattgggggcttgttcccccgatatcatttctatttctagtttgtttagagctctcttttaaaaactcataaacaattgatttttttcaaatgctttgttttgcatttactgatatatcaagtgatttttatgcatcattgggttaaggtgatatgtcacatttgctcatttttgtgtgttctattatccttaaatctagggataaatttgtcatttcttttaggaaagaagcaatgctgagtcttgaacatagtaaaagccaagcaacactactggtcttgtaatatcaaaaggaagagtgagactttcttcacaatttaattattgagtagtttctttgcaacagtaaaaacaacaaaattctgctgaaaatgaaaccaaagaattctgagtatttgaaaaatggtattaatattgtgaacggatgtcttaatattgggtcaatgtataaagtgtgaaacacagctcagtaatttttgtgcatgtgccacttgtgaatagaataatgtatttcacataaacccatatggttttacattattttttatttttccttgtttttaagtatttgactaagaatatttctaacttttaaataggtactaaatctctggaaaataaattttgacctaacagtgtaagttataaaaatatgttttgtcacaggaggaaggaaatcctctgtatcaacctcttcatgctggaattaactgaaggaattctatcttttggtcattccagcttcaagccttttatgtaactaatcccttttctccttctttcctgttttagcaaactttcagaaagaaaacaggcaacatcttgtgatgatgaagatcacagttgacacataggccagcaggaacctaatcacatgcaagttgtggtattggaaccaggtgaggtcgtgggctgcaacccgaaggtgcttggctcctttgtgctgcatgacaaactcaatccagaaggctgcttgatccaggggcttaattggcaaatcatggcgaattattgataacttcatagcattctctttgtagctgaaggataaacataaaaataccaacattgaaagtaaatttatttcctaagtctatggatggtctttgaaaagtgtcacatcaatgcttcaaagtaaatattatagaattgtcataggaatcgaatgttttggtttggacaaatgtagaaagtttattttttaaaatggaattttataaagaaaaatatgtcttaaattaaaaatggaaggtctgatgagaaagttaatgtctttgtagcagaggaaatattttgagccattctatgtgctacaggtaagacagtggaaatgcaatctgagattgatcatcttgatattttattttatttttttttgagaaagagtctttctctacggcccagattggagtgcagtggcatgattatgggtcacagcagcctccacagtgtgggcttaaacaatcctcccacctctgcctcctgagtagctgggactgcaggcatgcaccactttgcccagtaatttttaaatatttttttgtagagatggagtcctaccagtttgcccaggatggtttcaaactcttgggctcaagtgatccttttgctttagccttccaaatttctgggactacaggtgtgaactacctttatcgacccattttgatatttttaaggaaaaattgtttcacagctggtgtaatatttctaaattagtctttctctttctaccctactattctgtgttctaccatattttcctctcagtagtcagaataattttttgaaataaaagccagattatggcattcctctgataagattttcacctggcttctcactatattaagaataaaatctaaatctgtctttgttctacagaaccctacatggtcaggcatgggcaacttcttctaacactttccccaaccaccttctctcctagaggcattgcccttctattgttctttgagctccccaatgtgttctcacctgagcccctttacaccctttatcccctctctccctctcttggaatattcctccttgcaacaacttgaggcttgcttctatatctttttgaggcttccccttaaataatacctgttaaagaggcttttcgtggccacactatggtagtacctgtaggatttcctctattgttttgtgcttattttgctgtttaactcctggaacttaaaaatatgttacatgtcttctcaaataaaactttaagtataaaatacataaatgtacacaaattcagtgaatagctcaaaattttaacattaccttgaacaatatcctgatgtgaacaccaacttacctactacgcagattataatataagacatcacaacctgcctagaaaaactctgtcttcttgggccattttagtcactacttttgtcctcaagttaaaactaccttgacttctaatagattaatattgcttgtttacataatgaattatataatatatactcatttgtgtctttttttgggtagaagttattggctaattccattgctgtaatatgattcagtcaattgacaaataccacagattatctcctatttttatgactgatggatatttgggttgttaagatttttgaacactattactaattctggggtaagcaaatgtgtgtatatcattagatatacatattaatacatttttgatgggtatatacttgagagatgagttgctgagaaaaagatgcatgtagaattatgatgttttgttgactagctttttaaatacacaaatttaatttccaaaatttagagttgttttttaagttataattttttggataatttcgaatttatttctagtatggctagagcatttcctttttatgcttttgaatcttatcacatttgctaagtcctgatttttggcccagcagaagttcaattcactaactattccatatactcttaataaacgtatattctcaatatacattcacactcacctccacacctccacacataaaaatgtgtgtgtatatatatatatatacacacatatacacaaacttactatatatatacacaatacatatatatgtatacacacacatatatacaataggttatatttatgctcttcaaatgtttatttttaagtcacttttttttctctgtttaaatttagtatgagttctagtagattcacttttaaatctactatcttattctgtattttattttctgttttccaatctgctgtatgtttcttttctaattctttcctgtttgcttttaaactatttttaatcattcactgtcttattatcttcctggtaaggtattttcagtatattttctaagatggtacctccttatatatattgacaatagtaatcaatagtcacagcattttctacattatttcttttggagcacagaaaaattattacagatttattttctcaatattaaaactttgtgcttcaagggacatcttcaataaagtaaaaaaaaagaatcaacctataaagagtgggagaaaatatttaaaaatcatagactgacaaggcattccaccaataatataaaaataattcttatgaatcaataataagataaaaatgttagaaatgttcaaaagataggaataaaattttctcaaaagaagacgaatgacttgccagtaagtgcatgaaaagatggttatgtctttagccacaaggaaaatgcaaattaaatccacaatgaaagatcattttatatccactgggatccctgtaacaaaaagataggagataacaagtgtagggaagagcatgaagaaattggaaccctcctgtacagctagaagtaacgaaaaacggtgcaagtactttgaaaaacagtttagcagttcttcataaacatcaactttccatatggctcagaaattccactcctagtatcttctcaaaattagtgaaaacaacttttttcacaaaaaatatgtatagcagtgtttataagagctaaaattggaaataactgaaatgtctgaaagctgataaatgggtaaattcaaaatggtacattcatcaaagaatattagcaataaaaagaaaaaatgttctgacactttcaacaatatgggtgaaactaataaaagacattgtactaagtcaaagaaatcatttatagaacactgtaaattgtatgatttaatttacatgaaatatccagagagaataatctattgagaaagtaagttgatatttccctaggactggaggtttatcaacagtgattttatgcattttgaggtttattttagggtgataaaaatgttcaaaaattatattatggtgatggctttgtaactatgtaaatgtactaactacttttagatctcacttttaaataggtaaatattatgctatgcaaattgtatcttaaaataatgataatactaaaaatacattattgagcatgaatacagttatactttcagaaattttatgtattgaattgaaatactttattttatttctccaagttcattatttcattgtattataatccatcattcaaaaaacttatattttaaacaattatctatatatgtttaaaaatatttgtgtgtagaaggttgttacagtaattggtgacccattaaatatatgggatcaaatgtaactaaaataattggtgaaaaataaaagcaggtttcaagttggttaaattatttaaattctttcaaaattggtctcctaaaaggggtaagacatgtattcagtgttgtcaaaagaatctgtaaataccacatagtaaaaaaaattgtcatactcacacagggtcattaatgactgtcttcagtgcattgagcaaatctgtacttgacatggtcctgatgtccacattgagggccttcatgtgagcaatgttatcaggttgatctgcaaacaaaggaatgcccaccatagggatcccatggtagattgcctcatagatgccactggtttcaccatgagtcataaaagatttagtttttggatgacctaggattggataaattttagcaaaattattcataagactaaaatgagaaatgcacaatagaatgctctgaaaggggcagtgtctactaaataacagattattatacacatcaaactccattagaattgctttcggatttcagagaaagaagcacctaattcttctggaggtaagtgaaggctacatgaagaggtgggggcgtgtgtgacttcagactcaaaaaatgaattgatattgccaggtggacaaaatgaaaaagcacattctgaatgaaaaaaatgtgcaaaaaaaaagagaaaagaaaatcaataatattgtgtatgttagagcattttcccttaaatacatactgcggtctgagtgggatatgtggtgtatgcaaggcaacagggagtgtggtggtggtattggaatagaagaaaggcaggccacattacatcaggaaacgtgttatcactttatgataaagattgaggatttaggccgggtgcggaggctcatgcctataatcccagcactttgagaggcagaggtgggtggatcacctgaggtcaggagttcgagaccagcctggccaacatggtgaaacctggtctctactaaaaatacaaaaattagagaggcttggtggcaggtgcctgtaatcccagctactcgggaagctgaggcaggagaatcgcttgaacctgggaggtgaaggttgcagtgagccaaggtcatgccaatgcactccagcctggggacaagagtgagacttcatctcaaaaaaaaaaaaagattgaggatttattttcagaaaatgcagagttattggtaataaaagaggcactgttattttttagtgtcttttgaaattaaccctgaagtagggaaaaggacaggtgtaaagctgtacaaataggagacagagagacaatccaggaagttattgggaaaccccgtgagaggtaattatatctgaaataaagataatttgattctgaacataaagaatgtgagtgtctataataaaataccaactatatagttattttcctggtaagactggaaaataaatataaagtagttagcctttatatttgagttttttgataataaatgttccgtaagtttctttcaggttgaactatccttctaattagctgttagtcatatattcagtatttgttctgcagagtattaccaagaaggtcattctgggatatccacttgtacagctgagtattggatgctaaagtatttggtctctttccatccacagaacctgttggggtaaagaaaatatcttgttccatgagtagaatgccaaagctataagatgttagaactctaaagaaattgtcaatcaactagttaaaccccttccatataatagatgaaaaaacgagaacaagcaattttaggaaatgagtactactaaaagactattgaatatccacatttcatgtcttttattatcaatttggtatattagaaaatcatgatgttttcaacagagaagcttagacacttgagagtatcaataaaaaattcaaaaatttaagaaattattagacagtcattataattctactgtaaaatacagtaacaaattagtgacaacctatacatttattttatgtattttatactacctgtaatcttccaaatttaatgttagtttatttcttgagtgaaatgagaagtgttacttatatatatttttctgtaagttattttgttagtgtttgacatctttgatttataaaaaacaaaatctataaaatcagctacctgtgagaaataaatcagtgctacataggtagtacatataacttcttgtagattacacattacccagcactacatccaagaaaaatttcaagtgacaatttctttcttttcttttcttttttcttttctttctttctttttttttttttttgagatggagtcttgctctgttgcccaggctggagtgcagtggcaccatctcagctcactgcaaccctcgcctcctgggttcaagcgatttttctgcctcagcctcccaagtagctgggattacaggcatgcactgccatgcccagctaatttttatattttttagtagagacggggtttcaccatgttggccgggctggtctcgaactcctgacctcaagtgatctgcccacctaggcatcccaaagtgcaagtggcaatttctgagtcaaattcaaagtactatcattttgctagttttggaaattcttccaatgtaggcgaaaagagccaattggcaatttatgaataagaatatacacactaaaaattgtaaaattatattttgctaaattttgcttaactgatcattaacacttagatgctgctataaagcatcgacagcatagattaatatgggctgctttagccaagccatacccatagacagtaccaaaataagatactgattttagattccccaagcaatccttataaactggagtgtaatttacaagtgttttccttgtatttgctatgtgagtgttaaagtaactttgtgtttccagaaaaaaattagcataggtcattaggagaaggctatgtcagagaggaaactaaaaagtaactcacaaatacacaaagacttcaagtgtattctgcatactacaaaataagttcctactatatttcatggagtgagggcatctgaacctctttccatgtctggcttccttctgcttgactccttcttatattcccttctccttcctccgttgggaggaggtgtttttctgatggttagagcagaggctttatgggaccacattttataatgcacggagtctaccctaaaagcaggattctgttccctccttttctatcatattttcctgtttaagacattagcaaggcccagtaaacagggcaggcaagttcttctgcttctctaaatctacttggctaggtggatacctccagaatagcggtttgtcagcctggacatcttttctctgaatgcattctgaattgcctactaaataggtctattccaaaatgtacaggaagtacaggagaccagattacctagcaagcctaaattgaatgatgcatttcagacttttttcaataccttattgttattgtaatagtgcagtaactgattaaaatgtaagtgattttaaataatatctatagtgtataccatgttctcaggaaacttgtaagcaaaagggacaaatgacagggcagaatttggtgatttctatgtacatgcctacaatactatgataataccacaacttcacctgcacctcttaaatatattttttctgatcacaatattaatgtcagaatttttatcaatcaaacacaccctcgttattttagtatcttccatatatatttttgtttttgaaccaatatctgagataattagagctatcatatcagttagtttttctggcagaaaatttctgtgattggactctttacagagtttaacagactcattcagtagctgtccaccattaagacattttatctaacctttcgtggaatctgggcaagagctgatgcaatcacgttggccctttcttctgtgatgttactgaccatagacttaagcaagactgccacgacaccattttctccagagctctgcacaaactcttccattttctgtgaagaatttgttctatcacaaaagagtgtcagcatagcaaacactatagaaaagattagtacatacatctaagaagagaaaatcaagcattatcagaaatttttggagtaatggctattttttaactgacctaatctctttctttggaagaagttatggaatatgatatacatggcatctgttatggctatttgtgtaaatatgtgtgtctgtaaaaggaaaagatgaaaaacaactatgacactatagaagaaggagacaatgctagaaaatattatacccagactcttcatttacaatactgtaattactaatatgggttcttggaaggtggcatttgttgtgtttaattccatatgttgtagttctactaaattccttgtgtctattaaggcagggttttttgtttgtttgtttgtttgttctttctgtagagtatttttagttgggagtcattggaaccattacctggctatgagcagtgaggaaaagttactattgaaataattttatatgtctatttctttagctctgtaattctttatacctcatttaaaacttgtcagattatgtctttttccctaaaaaaaaatctttaaaagctgaagtttaataatgatggagattcaagagtctgatactgtggtgtgaaatttctgtgaactagtcctgagaatcccatttataatacagaattatgcagtatatagttacataactgagtgattgtatttctcaggtcattgtttaaatattactaagacactttttttcctgaaatcacactgcataaaatgatatgctactggccaggcatggtggctcacacctgtaatcctagcactttgggaggtcgagatgggcagatcaccaggtcaagagattgggaccatcctggccaacatggtgaaactctgtctctactaaaaatacaaaaattagctgggcgtggtggcacacacctgtaatcccagatactcgggaggctgcggcaggagaattgcttgaacccgggaggtggaggttgcagtgagccgagattgtgccgctgcactccagcctgggcgacccagcgagactccatctcaaaacaaaacaaaacaaaacaaacaaaccaaacaaacaactgatgtgctacctataactgcctgtgagggaccctcatcatcacttttctgtgtctcacaggggcacttaatcctcagtggaagaatctaccagtcatttttccagtggagatctcttcactatcttgagtagctcattcacacaatataaagcccttgttgaatatgtgtttgcttgaaatttattgagaattactctgaattgtggtttcccttatgttctcatttgtaaatgtaaatgcatagtgtaattccacattgctcagtgcatacgcctatcaagacaaaataaagagaaagagaaatgtagcgccaaaagttttcagtatataatgtcaaaattgaatacccatctttttgttgttgttgtttcttttgttttccatttattatttatttattttctctgtaaaataatgatgaacccattctgacataaccggtatactttcagatcctaaacatgggaggtaaactttcttttaaaaacttgtttaaaaaaagaaatcctaaagtttgtgtatgcacaacatattttgccaagtatttttcaaaaatataatttgagccttatgacattagttttaattggagagtcactgtactactattccaggtagttcttggggctcccaggtattctgtgtgactcgttacctgtgtgaacacaaagtatctgaaacagttctcaatttagaaagtttattttgccaaggataaggacatgctcatgacactgcctcagaaagtctcaatgacacgtgctcaaggtggttggggcacagcttggttttacacattttagcagacatgagacatcaatcaatatgcgtatgacgtacattggtttggtcaggaaaggtggggcaattcaaagtgatgccttcatgtcatagataagagttaaaaggttgcattcttttttgggtcttagatgagccttttgctgaatacacagtatacatatgagagaagggttgagaaatagtcacttatgccttagtctgactcagtaaatctgcattttttccataaacaatggtgaagggatggctttgagttctgtcctcttttgtccctcacctgtgaagataagctatcaatttacatttccagggtgaaattcaacagaaatgtttcaggttaaagattttgaggcccacaaggaatttcctcttgggaagattgtaagggaggtatgtaacttaaaaacaacaacaacaacaacaacaacaaaaacccaactttgtagctattttatttaggaataaaatgggaggcaggtttggctgatacagtttccagcttgacttccctttgacttagtgactttgggttttcaagattatttttctttcagacctgtagccacatttaatggaacttgtgtttgatgttttttctcaatgcctcgctgcccagagtcttcttcatccacccaatattgaggtagcatattgtctgtttatacactcatcagtgatctcattctgggatatcttcatgaaaataatatatcagtgtacaaaatattagagtatgaaaagcttaaaaaaattaaatttccctcatactctctgtctagagctattcctgatttaaatttgtatgcttttattatggtttttattctatttatataattcactgtgatgtttatttagataattttaatcttattgtatattccttttcatcctgcataaaaattgtgatctagttctattcatcattttgtttctcagtttccgacaattcttgtattatagctgacactgtaattatacatattttgataaaatgattgtaatggcatagaatgcatattgtatacatttttacatagtacccaatagtttttcaggccttctgcccttctcttccctctgtagtagtccccactgtctattgttcccatttttgtctatgtgtgccccaagcttagctcccacttttaagtgagaacacatagtatttagttttctgtttctgggttaattattctggttcatgtgtgtgtgtgtgtgcacaaatctccatgtatttgtttgtttatcttggctttaatctgtcattttattttcttttttcaaatgttgtctgcctatctatctatatatttatctatctaatctatctatctatctatctattatctatttatcatctatctatatatttaagaatgaggacatagaatgattcactgggatatctttgtatctgtgaaggacttagtatctggttggctttgatttttatgctgaacgcgtacaactactagaccttacctaaagggaaccaaaaatttcataaaaaagattatactttgatgtgttacatcaattctagttttctcattttaccctggtgaatttatttcaatttctttaaggaaaaactctctagtttttgtgtggaaagtgcaaagaggaacgtattatgtaatacagtaagggttagtgcatttcattttcatgtctttagtttcctttagtctgtaattatcccttcattttttgtctctgttaatttttgacttctagatgaattattgaccagttgttttgtagaatgattcttattttacatttgtttaatgttccttcatgattaagttgctatcacacattttttgaaagaatactgcagacatgttgttgtagtcttcacattacatcatttttgggcagcagatagtgttgatttgtcatgctggtgatactaactttgatttcttggttaagatgctgtctacaggtttattccctgtaaaattataatttctcattttggaattagaagtatcttgataggagactttgagactgtaaatatcctgtttccattacatcctttccctctaattttagcatccattcaaagataatttttgcctgaattaaattactgtggagtttgtctaatgattatttctatgtctataatttctttaacaattagtaagagaaattctactctaagaaagaacattttttcccttttatttccttatactggtttctgtcaatatgatttcatgagtatttggtttattccaaaggttacaatccacagctatcattattccattgctcaaattggtccagattcgattcattgggacttccttcagtttccttctatatttttctgatatgttgtcatcatgttgtatacttatttactttctggcacccctagatatttcaggcacatcctgtacttttgttgcctcaggggtaatgtcatttatatcttgaggaaggcatggttcgttttattggagtatagtgtctagaagcaaaatttcaagtacttagcatgttcattgcatctgggatattattacttctaggccatttacgcatagacattttggaaatgtatctatgcataacttttcattaacagcttaagagaataaataaattatcatttccataaaatacagaaaaaggagagtgtagtaagctaaaacatggtaaatctaaatagtaaatatttacagataagctcaaactaataatttaatgtaaaaagttattttcatttaatgtcatgtaatagttatatatcaatttaaaaaagaattaaataaactcacccattatggtagagattctcagatatttcaatctagcttttatttttgtttaaaagagaaacacctaataaaaattacccatattactataaaatatatacagattttacaagaggcatatacccaatagcaaataaatgaaaattgatgcaatgctacaaaaatcaaacaaagcagaattaagatgcgaagtatcaaatgtgataagtgaatcatttcatgtggatagaaataattcacttaaaattaacaataataagtatttggagattgaaatatatctcagaaactgatagattgaacagagaaaataaattctatgaaagttgattgtattagcaacaaaagtaacaaaaataacgtactgaatcctgcatcttcaaatagagtataaatattcttttgaagtgcacatgaaaacttttataaaattaaactaaggcaatgtcacagatgaaatctccacaaattctgaagtatatatatcatatgtatctatataatgtgatacaattaaaataattataaacttaaagagaatgtattacctttcaaatatacacatttaagaatttcattcagtggagtggactgtgcttaccattcatgacccaagtctttactaccttttctgctccaaacacatataccatgaagagaagacggcatagaatatactcaggtaagtatacaactgagaaaacttacacaccagttgttagcattagagaaaattatatgaatagattcttataggagctataacaagatggttttggcaggataaaaaatgtggcaaaagccttaaaagtggaaaacaaaatttacctacggagttcagggaatttctgttctgaaaaaatgtaagttgtaataactaaaaaattaaaacaaattataatgaaactgatctctctagatgacagcagacacatgcaggaaatgaaagtttgcagaaattaacagctgttgaagattaactcatgaaaaccacatgaggaaataaccaattctacacaatagtaagattttcacccaaagtttataaatataggaaaaaatcaaaataattttttttctcagagatgagaaaatacttaacataaaaatggaattgggtgagaagcatgaatagaaagaggaacatttagaaattgtggaaattagaaatacagtcactgattgtataaaatgtaatagagttcacaaaataaaatggaaccgaatgaacgaataaaagaatgaacaaaacctgcaataaggtgaattagtaaactttctctttttctgactgaaccttgactgatagagcttccaacagaaatcacctaatactgtaggaattgccattaagctgattaaaatatgaaagtgttatttgctattaccacatgttagagccctcctgattgcctgctttacttctgaagctctgtcattatggtttcctggttttaatcactcattctatgcttcactgaaatattttgaactgattcaatgtgtttctctcaaatttaattttattctatcctgtctcttgcctcctgcaggttctcactgtgagcaatccagctccagagcttaccttctctgacctagggttcctcatttttttttttttaccagtttatctgaacttcattgatcttgttcctttgccaatcactctgagccactgtcatcatgactcaggattctagaatttgaacaaattataaatttgccctttgtatcttctgtatcccaaagaagaaccagtagacggtaccacaagagaaaaatgagtgcagtacatgaacaaaacacctgaatgaatcacaaacaaaaagagatggttgattagatttataattaagcatttgccaatcaaatcagtgattcatttttatattatttggattggtaaaatttaacatccaccatagatgaagcacgaaataactgtccactccagtgctgcataggtgggtgtacatagagggaggtagtgtttgaaggatacccctgggctcaactgactcaagctagctcagtcttggtaagagggagactggacacttctggtacagttgggctgcagacacactgtaccaactgtaagttcactttggtgagaatcttcatatgccctcacttgaaagaattttcttttccagataagtttatgccttttattcatccgaattttaccatgatgctgtgctcaaagatacaacaacatttgaggcactaaaaaatgaaaaattttaaatattgttgtctgctctaacagttttcaatttactgaaggtggaaattttacagttattaagaaataaagtaaactgaaaaaacataggtggagtgagactgagagaaaaagaaatggagagagtcatggaactcttcccagcagggtgaaaattattggatatttattaagaaaagggatgaatgaaatgaaaattaacatggctaaaaaaaggtctcaacacaacattatgagaggtaaggtggtcaaatgagactttttgaaattaatccaacctaaaagggccccaaactaatcagtttcatttatcgcagtgtggagtagtttaaaaagcaggaatgcagagatcacagttagaaagctgcttaataatttcttcagataatgctgaggcagattaatcaagataaaaattaacacacaaaaaaagggtttattggtttaaggccctgctgttgacccaaagccttgtgtaagactgtcaggggatagggaacagaaattccagagactccttaatacaagaccccatgtgatatgctaccaagatgcattggggaagccttgaccgaggttatagttaggttgagaaaccataaaaatataaagattaatagaattatgaaatttgtgatatttaaacaggcttaatttaaagaaagtgtgtctttttaacttaaatgtcttatgaaatggactttatgtctggctggaaacacttgttctgcctattgataatattgtaacacaaaacctgctgataaagtcctaaaggagcttaagtaaaggttaatgaaatgaaaaggaaaatgtataggaaagttggtatttttgaacatactttatgtgaagtagtatctattttatctgaatgtgtcaaggttgaaggacactgtatctaactaggaaatgtttcttgaatctaatattgtataacagaaggtatgcaaatttgcccttcagccaacattaattggacatgctaaatgaaaaccactatggtagggtggagtcaagatggccgaataggaatagctccagtctacagctcccagcatgagcgacacagaagacgaatgatttctgcatttccaactgaggtaccaggtgtatctcgctgaggattgttggacagtgggtgcaggacagtgggtgcagtgcactgagcatgagccaaagcagggcgaggcatctcctcatctgggaagtgcaaggggtcagggaattccttttactaaccaaggaaagggtgacagatggcacctggaaaatctggtcacttccaccctaatactgtgcttttccgatggtcttagcaaatggcacaccaggaggttatatcccacacctggctcagaaggtcctacacccacggagtctcgctcattgctagcaaagcagtctgagatcaaactgcaaggtggcagcgaggctgggggaggggctcccacaattgccttttgtttggctatgccctgaccccagaggtggactctacagaggcaggcaggcctccttgagctgtggtgggctccacccagttcgaacttcccagccactttgtttactcaaaaccgctcaactatatggaaactgaacaacctgctcctgaatgactactgggtacataacaaagtgaaggcagaaataaagatgttctttgaaaccaatgagaacaaagacacaacataccagaatctctgggacacattcaaagcagtgtgtagagggaaatttgtagcactatataccctcaaaagaaagcaggaaagatctaaaactgacaacctaacatcataattaaaagaactagagaagcaagagcaaacacattcaaaagctagcagaaggcaaaaataactaagatcagaatggagctgaaggagatagagacacaaaaaacccttcaaaaaatcaatgaatccaggaactggttttatgaaagaatcaacaaaattaggagactgctagcaagactaataaagaagaaaagggagaagaatcaaatagatacaataaaaaatgataaaggggatatcaccaccgatcccacagaaatacaaactgccatcagagaatactataaacacctctatgcaaataaactagaaaatctggaagaaatagataaattcctcgacacaaacactctcccaagactaaaccaggaagaagttgaatgtcttaataggccaataagaggctctgaaattgaggcaataattaatagcttaccaaccaaaaaaagtccaggatcagacggattcacagcaaggacttcatgtctaaaacaccaaaagcaatggcaacaaaagccaaaattgacaaatgggatcttattaaactaaagagcttctgcacagcaaaagaaactaccgtcggagtgaacaggcaacctacagaatgggagaaaatttttgcattctacttatctgacaaagggctaatatccagaatctacaatgaactcaaacaaatttacaagaaaaaaacaaccccatcaaaaagtgggcgaaggatatgaacagacacttctcaaaagaagacatttatgcagccaacagacacatgaaaaaatgctcatcatcactggccatcagagaaatgcaaatcaaaaccacaatgagataccatctcacaccagttagaatggcaatcattaaaaattcaggaaacaacaggtgctgaagagggtgtggagaaataggaacacttttacactgttggtgggactgtaaactagttcaaccattgtggaagtcagtgtggtgattcctcagggttctagaactaggaataccatttgacccagccatcccattactgggtatatacccaaagaactttgaaacatgctgctataaagacacatgcacatgtctgtttatagtggcactattcacaatagcaaagacttggaaccaacccaaatgtccaataatgatagattggattaagaaaatgtgtcacatatacaccatggaatactatgcagccataaaaaatgatgagttcctgtcctttgtagggacatggatgaagctggaaaccatcattctcagcaagctatcacaaggaaaaaaaaccaaacaccgcatgttctcactcataggtgggaatagaacaatgagaacacatggacacaggaaggggaacatcacacactggggcctgttgtggggtgggggcagtggggagggatagcattaggagatatacctaatgttaaatgatgagttaatgggtgcagcacactaacatgacacatgtatacatatgtaacaaacctgcacattgtgtacatgtaccctaaaacttcaagaataaaaaaaaaagagtttttcaggatgatggtccatcctgaagtacataggaaaaaaaaaaaaaaggaaaccactatggtattccaagttcatacaatgtagaatagaagctggagtgttagtacagaaagcattatctgttcgatagcccggataaacaacttcaggaaagtttcaggatgcaaaatcaatgtgcaagaatcactagcagtcctatataccaacaaaatccaagtcaagagccaaatcaggaacacaatcccattcacaactgccacaaaaaataaaataaaatgtctagaaatacagtttaccagggatgtaaaatatctttacaaggatcactacaaaccactgctcaagaaatcagagatgatacaaacaaatggaaaaaaaatccatgctcatgggtaggaagaatcagtatcattaaaatggttatactgcccaaagcaatttgtagatttcatgctattcttatcaaactgtcaatgacatttttcaaagaattagaaaaatgtattttaaaattcatatggaaccaaaaataaaaagcccaaatagccaaggcaattgtaagcaaaaagaatgaagctggaggtatcatattacctgatttcaaactatgctacagggccacagtaaccaaaacagcatgatactagtataaaaacagatacgtggatcaatgggacagaatagagaactcagaaataaggtcgcatacctacaactgtctgatctttaacaaagctgacaaaaaaaatggggaaaggacaccctatttaataaatggtgttgggataactggctagccctacgcagaagattgaaactggaccccttccttacacaatatacaaaaattaactcaagatggactaaagacttaaatgtaaaactcaacactataaaaaccgtggaagacaacctaggcaataccattttgtgcataggaacttgtaaagatttcatgataaaaacaccaaaagcaactgcaacaaaagaaaataaaaatgacaaacagtatctaagtaaacttaagagtttctgcatagcaaaataaaatattaacagagtaaacaaacatactaaagaatgggagaaaatttttgcaaactatgcatctgacaaaggtctaatatctagcatctacaaggaactaaaacacattttcaagaaaaaaaacattaaaaagtgagcaaaggtcatgaacagacacttttcaaaggaagtcatacatgcaaccaacaatcacatgaaaaaaagctcaacataactgatcattagatgtagatgatgggttgatgggtgcagcaaaccatcacagcacgtatatacctacgtaacaaaccggcatgttcttcacatgtgtcccagaacttgaagtataataaaaaagttaattaattaaaaaaagaaaaatgtaaatcaaaaccacaatgagataccatctcacaccagagtggctgttcttaaaaagtcaaaaaattaccgatgttgatgaagtcgtggaggaaaggaaacacttgtacactctaagagtgtaaattagttcaatcaagaccagactaaatatagatatgcatccagaaatgcttttagaaaatatatcatatgtttataatacataagctaataaaatgggagagttctctgattcccctggcaggatgtgtgacaggggtgtggctcacctgtttggtcacccggcagctcaaacccctaaggcagatgggcaggtgcagaggccaggcaggtgcagaggccagggcagagcgttttggactctcagccccatggcagcgtctagggctgggtgcctacaaccacagtgttactaagctctgtcagctttgccatctgcaggcggcttgtgtgttagttagcccaataaaccctctgccttatctcaagggcagaaggccagtgtgacagtcttatgtatcctgagttcttgcccagtgtcccaaaagaatcggatcacacgtgagcgtgaaggattgaatgcaaggttttgttgttgttgttgttgttgttgttttctttcgttttgtttttgttttttagagacggagcctcactctgtagcccaagctggagtgcagtggcgccgtcttggctcactgcaaccttcacctctggggctcaagagtgaatgcaaggttttattgagtggtgcaggtggctctcagcgagatggataggtagcagaaggagggatagactgggaaggtggtcttcccctgcagtcgggctgcccagaggcaggactctgctctgaccgccgccagctccccaccaccccacctctccgctgaactatcctaagcatctagagaggtccctcctcttctctatttctctgccacatcgttctgccgttgctagtctgcttgtcggctggtcgtctggccttgatgttcagctgcttgtgtgtgtgcctgctaaggtctcaggtttatgtgggcacagaatggggggcgtggtaagccagagaggtcttggaaaatgcaacattcaggctcaaaaacaggagtgcctgttctcaattaggtctgtgggcacatgcccgagggtgaatccctcaccagtgaccttgctcttctctaccccacacttcgctgcccaatctccagttccactaatatatctaaaagtcacatgggatccctccagtctagattattggtgagactactgaaagcttcaggtacaactttaacatctgcttaccttgtttttttttctcttaaacagctttagtaatgtataattgatgtactataaattctacctatttaaagtgtacagttgataagttttgacatgtaaacattcatgaaaccattactacaatcaagataataatagatcaattgccgcaacagttttatcatgttcctttgtaattgtcttatacttctccccagtctcctatagccaggtaaccattcatctgttttctgttaatagagctttgcttgcatgttatagagtttcatataaatggaaccacagtctgtatacttgtttcactagcatctttcactcagcatcattatttttattttgagatttatttactcttcatgtaccaatggttcattccttcatagtgcggagaaatacctcattgtatagatatgctacaatttttttattcattctctgttgatggacatttaaattgtttccaatttgaggtcattgcaaataaaattacgatgaacatttgtgtaaaatctttaaatggatatgtgttttcatttctcttggctaaatacctagaagtaaattggctagatcacagggtaagtggatgtttaactttttaggaaactatcaaactgttttccaaactgattttaccattttatttccaccagcagcgatggagagttctggttgctttatattcttgccaacatttgatatgacctgtctctttaatttcagcctttctaatatgtgcatagtacttcattctggttttagattgcctttccctaataactaataataataagcatcttttcatgtatttactgaccatctgtatcttctttggtgacatgtcttatccaacattttaattactttgttttattatttatcgagttttaagagttatttatatgtgttctatgtatcttttagcagatatatgttttgtaaaatattttttatttcaatagctttcggggtacaagtggtttttggttatatgtattaattgtatattagttaattctgagattttattgcaaccatcacccaagtagtgcatgttgaacccaataggtagtatttatcccacaccccattcctaccctctcctttctgagtctctaaagcccattatattactttatatacctttccgtactcacagcttagctctcacttacaagcgagaacatacgttgtttggctttccattcctgagtgatttcacttggaataatggcctccagctccatttaagttgccgcaaaagacattattttgttccttctcatggctgagtagtatttaatgatttatatatacacctcattttatttatctactctttggtcagtgtagacttaggttagttccatatctttacaattgttaattggattgcaataaacatatgtgtgcatgttttttttttcttcatataatgactctttttttggtggggggatagatacacagtaatggcattgctgtattgaatggtagatctacttttcatttctttttttttgagatggagttttgttcttattgcccaggctgaggtgcagtggcgtgatctcggatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaagttgttctgcttacttttgagtaatatcggtagctgacattttctgagtactgactgtgcccaatctgctctgtgtgctgcctatattttacctcacttaattcttatcacagtcttataagggatttttttttttttttttgagacagagtatgccctatgtggcccaggctggagtgcagtggtgcgatcttggctcactgcaacctctgtttcctgggttcaagcaattctccttcctcagcctcccgagtagctaggactataggcaagcaccaccatgcctggctaatttttgtatttttagtaaagatgggtttttgccatgttggccaggctggtctcgaactcctgacctcaagtgatctgcccacctcagcctcccaaagtgctggaattacaggcatgagccacagcgcctgacttgttatctttattaggaacaaagtttcttctgagtaaacatttagtctttttgttgttgttgttgttgttgttgttgagacagggtctcgctctgttgtctaggctggagtgcagtggcatgatatcggctcactacaatctcctcctcctgggttcaagcattcttctgcctcatcctcccaagtagctgagattacaggtgcgcggcaccatgcctggctaattttttgttgttttagtagagatggggtttcactatgttggccaggctggtctcaaactcctggccttaagtgatccgcctacctcggcctcccaaggtggtgggattacagttgtgagccatcacgccggcttcttggtggcatcttgatacagggtgtgctggatatctgtggccaccctgatcaattttccaccttgctctattccttaagaatctcattcatagggactacacaataatcgtttatcttctctcagttttggttgagttcaggcatttgaagataggaagaaagtaagggttttgaactatttattttcatggctccctctatgtagggttaacatagggtagctctgtctctctatctatgacctcaattccttttcaaccctatctatacatctattctatctgggctctagtaactctgccttccacttgcccatccaggcccagggtagtgctatggaatgaactcccatccacccccaaattcatatgttgaagccctattccccaatatgactatattcgaaaataagaccttaaggaggttattaaacttaaatgagttcataagggtgtggtcctgatccagttgggttaatgtacttattaaaagagacaccagagagcttgctttctcttctcattcaggcaccaaggaagggccatgtgaggacaaagcagctgtctgtaagccaggaagggagccctcaccagatattgtaccctgttagaacgaaccttgatcttggactgtccagtctctaaaactgtaagaaaattaacttctgttgtttaagccatccagtctgtggtattttgttatggaagcccaggctgactaattgggatagtaaggcactatcttgtatagtttcttaacactctgcccgcacttttgtaaagagtccctttattaaactccccctaattggcattcatgctgttttctgataggatcctgattcatacaaagcagacaatcagagaacattacccaagctaagaagagtgactgacccaaatgttctccttctctcctggaacttgaaggcataataagagtgcatcttatttctcttggtagttaggcttcagtttctgtttctgttttgaagtgtatgagactgctgtaactcatgctctgttcttttggcccagccaatgtatggcagtttcttataaggatcacaacccaccatctcctcaggctgaccagattcttcacttcagctcttgctggtactgtggatttttcaagactcacttatgtgcatactccatttgaccctagcactggcctttgcagtggtgactccttggagaaaaactcactcagtccatggttaacttgcacacacctccagagttacatgggcatttctagttctcttcacatcttgggaaaccaagagacaatctcctaggctccccctgcttaaacatgctacttaaccattttaactctactgtggccttcacattggctctaggcactctgcttccaaaattccaaacaggaagtggggtgcaaatcctatgtactttcacttaatgtctctgtagacattcagaagcacatttccacccaatttccctctgaccctcttcttggacaaagtttttgtgataccactttgatgataaagaatctagtgaggccttaagatacaacctaagaaagaaggtcaaaaactgcaaagtagaaagaacatttagatttctacaacttttgcaatttcttgtgtatgtgacgtttgtctccttataccacagagattaccaaaacaggcaccagaggaaaaaaaagatgatcaccaccaccaccaccaccatttaataaataatgtgtttagcataacttcaggatgagaaaagaagattagagctggtgggacagtgattctaagacttctcagaggtgatttccaggatgactactccaaagagaagaggcaagtaaactgcagtcctcaggacctgttgctaagaagaaaagaaattctgaagaatcaattcagatctgaaaatattggactgggtcgaaacacacttgaaaatataatctgtcatacattttctcattgcttaggagtatgggcttgggcataaataagattagcattttagcaaacatttactgcttagaagctatgtgaacgtggagaagtgtaacacagaggtgaagagccctggctccagagttagggatgtggcttgaatcctcgctctgctacccagagcaaattatttacttctttgagcaaattatttacttctttgaacctcattttgttttctttaactaggatagctaatccaatagttttttcttcatcaagtcatatgtgaagtacttatcactaacctgttgtgtgtatgcatgttagtgctaagtacttcagcaattgatcatcattattatcaacctgagaaaactcactttattcttgtcaaaggaaaataaatctcaggacccaaaaatcactaagccaaagggaagtcaagctgggaactgcaatgggcacacctgcctcccattctattcctaaataagatagctacaaaaattaaaaagctacatgcttcccttgcagttttcccataaggaaattccttgtgaacaagagacagaactcagagtcatccctgtgctcacgtgagtcagagtccagcctgggcagcatagtgaggccctgtctcgacaaaaatttaaaaacttagctgagtgtgattgtgtggttggctcatgcctgtagttccaattacttgggaggctgaggtgggaggattgcttgagccaggttgctcaatgctgcagtgaggtatgacactgccactgcatgtcagcctggaagacagagtcagatcctatctctggaaaaaaaaaatgcttgtagaatgtaaacatgaggccctgtctctacaaaaagttgcttgggtgtggttgagcccaggagtttgaggttgcagtgagcaatgattgcaccattgcattccagcctggataacagagtaagatactgtttgaaacaggaaaaagaaacaaaaacaacatttgtatgtgggtatgttttatttccggggggctgctataacaaagtattatagattgtgtcttcatattttggaaggggaaaacaagctcattggggccgcttttttaagggcactaatcccatttatgagggctcttctgtcacgatccaatcaccatccaaaggcccaacctcttaataccaacaccttggggcttagaatttcaacaaacggattttggaggcaggggacataaatgttctgatagcagggctttttagaagtgtcatgaataattaaattctaatcatggtagccaagccatgtatcagctttcttataacttaattagaatgccaaatactgtggaagaaacaataacattgcaagcaaatgtgttattgttactttgaaggaagttatcttctagtatagtagaagtagtagatattgtagtggggtaaaacgtgttttctgacaatgactccttttaccagtagtgaactggtaaatgtttaacaaccagctctccagaaaaacaaaataaaacaaaacttatttgtaatgtttgtcaatttatgtggtgtaattactcctaccatgaccaatttcaaactatctatgtgacatctcatcactgaacacaggaagaaatgagaagtaacaaaattttatagtattttcaccatacaggtgcaataattgtaaatataaataacctcaagaacaaataatattaagttataattgaaagaatcaggaagtggtgaattttgaatatttattacttttgtatttaatatagtttacttaactatacttaatattattaactttgtataatttattttttaataatccctatgtttaacaaccagtctacaaaaattttaaaaatttaacaactggctcttataagtcattacaggcaagcttcagcacaccattatgcttaactgcccctcagatacacagcactcatagctatatatgtatgattttataggatatcctggccacagctgatgagagtaaatagggatgggaataggttcaatgtcacttctcccagaatttggaaagggaatcagactggaaatcatcctgtttgtgtggctgaaactataactcatgaaaatttgaagttacaggcagtcactttttgaccattatgtggacttagtagtaaataagatttatcttccagtatagaagcataaaaatatgcaaagggaaaccagaaatggggaaacacatctcatttgtcttaaagcattctagatttcagcggcagttcttgagacctggttgcattctacccttcgatttggacagatacatttaccctcacagtagttttccttttcctctaatataactcgaattgctttttgttatttgcaaacaaaaagatggacatgaaggaaaaaggaaatagcaaaatacgcaaaataataagcgtagtataatactgggtgaaaaatgttcaattgctctatagctcatagatcaaaatagagaactttgccctaactctattcgtagataatgaacattaggataaatatttcaactctcctttttgagaaaaccacaatctaaatacagctacctttctctgtagattctactgtaatgtgtgcttggatttaactgcctctcattgtaaacaagattgttttgaggcagctgaaaggtaaagagctttcctttggcaagctcaacaactcttgtgacttaatcatcatctatacaagaatgattacttcagtcagacttctcacctgatgtcagttgtttccttgacatcttttcttagatgtctcatgattagctcaattttaaaaagctcaacagtacccccttgatccaccactacccacactgtccactaacctactcatgctagggatctgggaattagccttctcctcacctcacatctccagcacttgcagtacagtgaggaagtgagggtgaaggggaaagggagctaaggtacagacaatggctaatttacatctcttggtggcaagtgttacaacaggaatagtatacaacactatagagacatacaatgggaataaatccatgagttagtcatatgctcctttctagaccgttctctgggtactcactgcctgaaaaacatgattttttcttacaggtttcagctaattctgcatctcaccaagaaatttttccttgacaacctctccctaacagaattagttgtctctgttgtgttcctgtaaccgagtatccccatttttcttaagaaaaagggaatgaataactattattattttctcttctctttttccttttccccttgatatggtttggctctgtgtccccacccaaatctcatctgaaattgtaatccttccccatgtgtcaaggaagggacctggccatggggcgataggatcatgggggcagtttccctcatggtgttctcaaaagatctgagttctcaaaagtgagaagtgagttctcaaaagatctgacagtttaaaggtgtgtggcagttcccccttcattctctcctgtcaccttgtgagaaggtgcttgcctctccttcaccctttaccatgattataagtttcctgaggcctcctcagccatgtggaactgtgaagcaattaaaccttttttaaataaatgagccagtctcgagtagttcttcatagcagtttaacaatggactaatacagagaattggtactggagtttgaggcactgctataaagatacttgaaaatgcagaagtgactttggaactggataatgggcagaggttggaacagtctggcgtgctcagaagaagacagaaagacatgggaacaagtttggaacttcttagagtctagttgagtgattttgaccaaaatgctgatattgatatggacaatgaagttcaggctgagatggtctcagatggagataaggaacttattgggaactggagtaaaggtcactcttgatatgctttactccagagactggcagcattttgcccctgccctggagatctgtggaactttgaacttgagagagatgatttaggttatctggaagaataaatttcctttttttttgagacagagtctcgctctgtcacccaggctggagtgcagtggcatgatctcggctcactgcaagctccgcctcccaggttcacaccattctcctgcctcagcctcccaagtagctgagactacaggcacccaccaccacacccagctacttttctgtatttgtttagtagagacggggtttcaccatgttggccaggatggtctcaatctcctgacctcgtgatctgcctgcctcagcctctgaaagtgctgggattactggcatgagccaccatgctcagcctataaatttctaagaagcaaagcattcaaagtgggatctggctttttctaaaagcctgcagtcatatgcattcacaaagagatgatctgaaattggaacttaggtttaaaagagaagtagagtgtaaaggtttggaaaagttgcagcctgaccatgtggtggaaaaggaaaacctgtttttgggggagaaattcaagtcagctgcagaaatctgcaaaagtaaagagaagccaaatgttaatagccaagacaatggggaaaacctctccagggtgtttcaaagttcttcacagcagtccctcccatcacagactcagaggccaaggaggaaaaaatggtttcgtgggccaggcccagggcccccctgctttgtacagctttgggacacggttccctgtgtcccagctgctccagtgccagccatggccaatggaggacaaggtacagcttagttcattgcttcagagggtgcaatccccaagccttgatggcttccacatggtgttaagcctgcaggtgtgcagaagacaagagttgagctttgggaacctccaactagatttcagaggatgtatggaaacgcctggatgtccagggagaagtcagctgcaggggcagagccctcatgcagagctcatactagggcaatgcagaggagaactgtggggtggagcccccacacagaacctccactggggcaccacctcatgcagctgtgagaagaggactactgtcctccagattcccaaatggaagattcactgacagcttgcactgtgtgcctagaaaaactgcaggcactcaatgtcaggacttaatgccacccaatgaaagcagctgcagtggctgtaccctgcccagagccacaagggcagagctgcctaaggtcttgggagcccaccccttgcatcagcatgacctggacgtgaggcatggagtcaaaagagattattttggagctctaacacttaatgactgccctattgagtttctgatttgcacgggggcctgtagcccctttgttttggccaatttttcccgtttgaaatgggaccatttacccaatacctgtaaccccatcatacactggaagttattaacttgcttttgattttacaggctcataagcagaacggacttgccttgtctcagttgagattttggacctggacttttgggttaatgctagaatgagttaagactttggggtactgttggaaaggcatgattgtgttttgaaatgtgagaaggatatgagctttgggcggggctgggatggaatgatgtgatttggctttgcatcccaacccaactctcatcttgaattgtaatccctgcatgtcaagggagggacctggtgggaggtgattggatcataggggcagtttcccccattctgttctcatgatagtgactgagttctcaccagatctgatggtttaaaagtgtgtggcagttcccccttcatgctctctctcccgctaccttgtgaagaaggtgcttgcttctctttcaccttccaccatgattgtaagtttcctcagtcttccccagccatgcagaactgtgaatcagttaaacctttttttttaaaataagttacccagtctcaggtagttctttatagcagtgtgaaaatggactgatacacccctgttctccactttctacttagtcttttagtaatgacaatatagccttttaccatccccttcaccagacgctccctacagggtaagttcatctatgcactctaagacggaactctctttgagagttaacagtcgatttatagaccaaagcatgcctgctatggaactctcacccaccagagggttacctcaagagataacaattgaaaaacatgtccgctactgtctcccagctagggagtttttatcatagtcctgcccacaaaaatgccagaagtcaccagcttgacctcctggtatgtaagggaccaagctaacatgcagacccctcaccttgctcacttcctctcctgccttttaaaagtgcctgctttaggttctcactcataagtaggagttgaagaatgaaaacacatggacacagggaggggaacaacacacaccatggcctgttgggaagttggggatgaggggaaggaacttagaggatgggtccgtaggtgcagcaaaccaccatggcacacatatacctatgtagcaaacctgcacgttctgtacatgtatcccagaacttaaagtaaaataaaaaaataaaaaaataaaaagaaaaaagaaaatgaaaaaacaaaaaaaggaaaaagaaagtaagtgcctgcttttgctccagaaacaaagtagtacatttaaagtcaagactcctgtgcttcttcccctaagctagcttgggaaataaatcactttgtttataccagacctcgcttttgttaattgggctctgcaagcattgagtgactaacctgcatttattagttacattctcactgcatttgtacttgtctccattacaacaattataattatagatacattttaagttactatggagccccagcagaatgcctgtcacatcaaaattatcaaagaagtatttagtaaagagaagaaaaaaaagaataaacagaagatatcaacagctctggattctaccagtgaccagcattcaatcaactctatataaattattctctctgttcctatattttctcctttgtccagtaagaaattggactcatggccagatgcagtggctcatgcctgtaatcccagcactttgggaggctcagtggggtggatcacttgagcccaggtgttctgagaccagcctgggcaaaatggggaaaccccattgtgggggttcagtcaggctggtgggaaaaattttagttatcatagccacaaaccctcttggaaggcctgagagtttgcataacttcagtaatagatctagctgaaggcagcctagtccctttacctttagttaaataggttaaagtagatacaaaggaatgtgggggagtttatctaactagcttgtttactcatgtggtcctaagactaatcttagtgtgcttaattgctttctactcgggaggtccgcaatgtcaattaccctctagtggtgttgactcaagcctttgtcaattaatctttactgaatgaatgtgagtcttgctgtgtctaggctggaggttccaactatttacagcactcttcttggtgtctgtaagtggcctggatgctcagccagactggcaaagcagaatatctgtgtcagtgcacgttattcatctgtcattgggtcagggtctgcaggacagacccctgcaccccatctctacaaaaaacaccccctgcaaaattgtctgggcatggtgccacatgcctgtagtcccagctacttgggagactgaagcgggaggattccctgagtccaggaggtggaggctgatataagccaggatcatatcattgcacttcagcctaggcaatagaatgagaccctgtctaaaaagaattaaaaaaaaaaaaaaaggaaagaaaggaaaaaaagaaaaacgatatggagcttgaactttccttgactttgggcacgtcacatggcttcgatttcttcatctataaaatgtcaaccacagagttattgtgaagatcaaatgagctgtgcatgtgaaatgaaactacctttacaagcattaaatgctataaaaattttaagcatggcttttagtagttttagctctaattttctattattctaaatagtggaatgtggtagaagtatatcactgttttttctttttttctttttaaccagtggtggggataaggggaaggaagtggttgaaaaatcgaaagggaacttcttacttgggtaagtctggacttaattgtgccaaactttctaaagcagcttccaggacaaatttccaggaatatttaaaaaattgtttagactgactggaacacagatatgaagccacattttttgtgcacgtgtgactatgtgtgcctctggaagatttcaacacaaacacgctctcatctaaattaacgctttcctctgaattgactcatttgaccagcataaccagtttgcatgccagtgcaagcagagaaagttgtaataaaaagaagaaaagaatgaaaggcatttagaaattcggtggttaaatgtacacttagttaatcattgtatttgtttttcaagggcttcctaaccttttggagaaagaaaaatatggcagaaagctgactgaagtttgaaattaatatgtgcaaaatgtctgtagaggatctagtctatcctcctttccttcatcttaagacttaattttatccaaaaattaagtagcctgattagtcatccttgctttcttctcttcctggctccttgggttttttcccatatgtatttgttcagcatctattacaaagcaggcactgcccaaggcattgtttttaatgtacaagtagggagtttgaaattcatcctttcgatcagaagttctcaaactatacggtgtatatgattcacaaggaaaatttgtccaaaatgcagatttctagtcttaatcccagatatcagatttgaggctcttcgtggggcctggcaatctgccattttaacaagtgtctgggagagctgtggctcatgcctattatgccagcactttggaaggacgatgcaagaggattgattggaatttgtgaccagcctaggcaacactgcatgactctgtctccacaaaaatttaaaaaattagccaggtgtggtgttgcatgactgtagtcccagctatttgggaggctgaggtgggaggatggagtgagctgtgatcgtgccactgcactccagcctgcgagacagaggtgagaccttgcctcaagagacaacaacagggccaaacgcggtggctcacgcctgcaatcccagcactttgggaggctgaggcaggcggatcacctgaagttgggagtttgagaccagcctgaccaacatggagaaaccccatctttactaaaaaatacaaaattagccaggcatggtggtgcgtgcctgtagtcccaggtgagacaggagaatcgcttgaacccgggaggtggaggttgcagtgagcgaagatggcaccactgcactccagcctgggcaacaagagagaaactctgtctcaaaaaaaaaaaaaaaagacaacaacaatggccgggttcagtggctcacgcgtgtaatcccagcactttgggaagccaaggagaatggattatctgaggtcaggagttcgagaccagactggccaacatggtgaaaccctgtctctactaaaaatacaaaaattagtcaggcatggtggcagacacctataatcccagctattcagtagggtaaggcaggagaatggcctgaacccaggaggcatagtttgcagtgagccgagatcgcaccactgcactccagcctgggtaacagatggagattccatctcaaaaaaaaaaaaaaaaaagacaacaacaaacaagtgataagcaattcaagggactccattcacctgtttgaaattaataaaacacttagtgattagattaggttggtgggcagctgaactcttcaagattttatctatatctctttaagaactccagaatcggggctctctgttcgaatccagactctgccacttaggagctattcagttgattgtattaatcaagttaacctctttgtactctgtgtcctcctctgtgacagtacatgggaatcaaaatatctacctcagagagtcactgggcagatttagcagataaagcatgggtgttatctggcatatagcagtaagtacaaaaaagtagctacaataataataacataacatataaattaatataataacattgttaccattattggcagtagttttactgtggctctattttttagagagaagagagaagacacaaagttttgcccacaataagtggtcaggtcttggaatatgactagatgattgcttcaaaagagagaagtgttctgactgcttgtatatgtcttctgaggcggaaattgctgttagtaacaaccattttagtttacattttctaaatattattaaatccctgagtagtaggtaatattattgctattctgacattttcttctcatggcttaatttaaaagaatcaaaattatacccagctcagagaggtaaataacaaatgttctcaagaagcatctaaggccaggtgcagtggctcacgcctgtaatcccagcactttgggaggccgaggcaggtggatcacgaggtccggagttcaagaccagcctgaacaatacagtgaaaccgcgtctctactaaaaatacaaaaattatctgggcgtggtggtgggagcctataatcccagctactagggaggctgaggcagggaactccttgaaccctggacgtgcaggttgcagtgagctgagatcgtgccactgcactccagcctggacgacagagtgagactccgtctcaaaaaaaaaaaaaaaaagcatctaaaacaggggtccccaacccccatgacacagattctggtccatggtctttaggaactgggttgcatagtaggaggtgaccagcaggcaagcaagtgagcattaccacctgagcaccacctcctgttggattagtggtggcattagattctcataggatcgtgaaccccattgcaaatcgtgcatgtgaaggagctacattgtaagctcctgatgagagtctaactaatgcctgatgatctgaggtggaatagtttcatctggaaaccattcatctctcttgtccatggaaaaattgttttccattaaactggtccctggtgccaaaaaggctggggactgctgatctaaaagatgtcctcatcataatcacagataatgaatacagaatactcagtatcggaggaaagataaaaagttcagtttgggtcaatttcttcactatttacatacacttagggccttagacccttccatgctaaaatttaaatgcatgcattagctcatttaatctataatagccctataagtaaattgctattataatccttatttatttatttatacatttttttgagatggagtctcgctctgttgcccaggctggagtgcagtggcataatcttggctcactgcaaccttcacttcccaggttcaagcgactctcctgcctcagcactccctgggactacaggtgtgcaccaccacaccacactaatttttaaaatattttttagtagagatggggtttcaccatgttggccaggttggccttgaactcctgaactcaggtgatcagcccaccttgacctcccagagtgctgggattacaggcgtgagccactgcgcctggcctataatctcattttaaaagatgccattataaaacatctttaaaaatgaaatttattctctgaagtgtcaacataataagaaagaaaaaaaagacacttaggttaactaaagtaataaaggaactcaaacttgaaccaagagctatgtgatcttacatctcactttagtctgcatatcaaaccgcctcctagacactttgaggctcacgggtctgaagtgggtgtagtggcatcctgggaagatttaataggacaacaaaggtaagtcacacaatgagctctaaattctagtctgtccaaagcatgctcctttctaaaattatattctaaaatgttaagaaaaaatacaaaaaagggcattttcagaaaatgttttatagtccttcctctgaatgactaactttaccttttttctacattgcatattctttatcccaaacatatgcagaacatgttgatgtgttctctgattacaaagtgttttcaaatgataatgtaatgactcagtagacttgtgaaatgcaggcagaaaaaaatcatttaaaaccaaaattgactgtgctgcttctacctgctaagggaagtggtctaattcgcatcagaggggtaagaggcagagttcccttccccttttgtaaaagaaaaatggggacagcaagcaaaaaatcactcaattgttaggaaaaaatatctaagccaccctctcaccttccttctctttcccaagaattggttgcactactgaaaccagaggagtgcaggaattccactattttgtaaaataagtttgagccaaatttgcctgaatttctaagacaggctactttggttgatacacggattaagcctaaaaataaaaccttttgagataaattgggtagtacacccacagaatcgcgcccgagtcaaggagggaaatccttttggtattgtgtttaaaaatcatttttaattttccctacaacgaagcgaaactcctcacatgtgtttaattgttcgctctgaaagactacacaggccgttacgaaaatagtttttggcatgagtagtgatctagttataaatcagtgaaaaataaattgtgtccataaaaaagttacagaatttacccctgtgccattaaatattagttaacaaccttgatttttaaattgatgtgccatattctaccatatcgatactgtatttgatatggttcagttgcagactgctcttccagaataaataggcagaaaggaatttatcactggctgcaaaccattagatggcttacaaactgtttggaattgtaggggcaggcgctgtgtgagcgtttaggaacaacttccattctccagaaatggcatgggtagtcctgcgatccaaaggcagcagtgtcaggtggaagcgctagaagcccgaggctgccattggcagaacaaagcagtctcggcctggcttggcagcatccaaaaggaccgcagccgccctgccgctgcacacggtgcatctgattggcggaacccaaacccttccgcagccctccctgcgaagatatctgggaaacgtagtttttaccttctaacctctaaggcacggaaagcttattcgatgttgattgtaatggaaatagaactatgtattaggatttgtttaaccatcccttgagttttaaattttttggttgttacgtaattttctctgtaataaataaataaaattccctaaacaatatgaatacttttcaaatttttgataatgattgcaaaattgctctcttgaaaagttatgccagtttatactccttccagcaatctttgttccatattgtcagtcatgattaatacatttgtcaatgcttttgaaaaggaaagtgacatattatttaaaaactatgaatttctttggctagtttgaagattttaattctcaccacaagtgaattacgattagatttttttttttttttttttgagatggagtctcactctatcacccaggctggagtgcagtggccaatctctgctcaccagcaacctccgcctcccgggttcaagagattctcgtgcctcagcctccagagtagctgggatttgaggcatacgccaccacactaggctaatttttgtatttttagtagagatggggtttttgtcctattggccaggctggtctcgaactcccgacctcaggtgattctctggcctcggcctcccaaattgctgggattataggggttagccctcgcgcacggccgcaattaagtctttagacgatctgtttccccagtatttcccagcaatgtatttatgaatcatctcgcatctcgcatggtgagaaacttaacatgaacgttcaaccatgtaaaattattaccagtgaaataaataacttaatgtctagtgacctcttactgtagctctgtattggtagatagacacttcttttttgatctttcaagtatatagtaaaaaaaatgttccttttacagttttcaatttttttttttttttttttttttgagatggagtctcgatctgtctcccaggctggagcgcagtggcctgatctcggctcactgcaacatccgcctccccggttgaagcgattctcctgcctcggcttcccaaggagctgggattacaggcatgcatcaccacgcctggctaatttttgtattttctttaaattagagacagggtttcaccatgttggccaggctattctcgaactcctgacctcaagtgatctgcccgcctcagactcccagagtgctgggattacaggtgtgagccaccgcgcctggctaatttttcatgtttttagtagagacggggtttctccatgttggccaagctggtctcaaactactgacctcaagtgatccacccgccttggcctcccaaagtgctgggattacaggcgtaagccatcgcgccctgccttgttttcaaaattaaacttagttgaagcctgtaagacttaaaatgaaagcaagattatgtgacttgattatgatgcagccaaatgaatttagatgcaaatgctagacttgaaatgtaagtgtacgaatatacagcagtataattttatgaggtctgggggttacttgtgcatgagcccaggatttagatatctggctactcacagtaagatccatggaaggaaataaattctataaggaagcactgtataactcaaagaaactagagaggcccaaatgtccaaagctgccatttcgcttgctggaatttgctggtggaataactacccttccccgaattaatgaggctaaatgaattcctggggaaccctcaggctgtcagtgtaacacctcccacatcttttttctccagcaggtggcatgtacagcaccatcctgaaatggtgataactttattattattattgtcactattcatggggctaaccatcttcccttttcttcccaaataagtacatggagttttagcataggtattaaagaaggctcgtcagcatgatggcttaagtctgtaatcccagctactggggaggctgaggtgggaaccgaggagttcaaggctacagtgagctatgatcatgccactgcactatagcctgagtgacagaaggagaccccgtctgtaaaaacaatttaaagagagaaagagaaagatagagagagagaggattcttgtttcaatgacctagaggaaaaaagatgttataagttcgcttttgaaactggaacattaatttttcaccatattaagacaagaccctgtatatacacgttaaacttaaacagctatcttttaggctgttgaatgcaagaaggtaagtttaagtaccatctagtggtaggcatcaccctccacctagtggcatccctctccatctagtggcaagataggcgaattgaaagcaagtgccaaagaagaaatagtctgatactgaaatgttgagcaaaagtttaaaaagacaacagtattgaccacgcctcctccaagtcccagcgagcccgtgtacaacctgtcccgactccagccgcctcttcagctcgccatggatcccaactgctcctgtgccgccagtgactcctgcacctgcgccggctcctgcaagtgcaaagagtgcaaatgcacctcctgcaagaaaagctgctgctcctgctgtcctgtgggctgtgccaagtgtgcccagggctgcatctgcaaaggggcgtcggacaagtgcagctgctgtgcctgatgctgggacagccctgcccccagatgtaaataacgcgacctctacaaacctggattttttatgtacaaccctgaccctgacgtttgctacattcctttttctatgaaataatgtgaatgataataaaacagctttgacttgaaaaaaaaaaaaaaaaagagaatagtattaaagtaccagataaactttaccactgttttattaaattttaatataaataaactatgtaaaataattcatgattgtagcaggttatctaatttggaaataaaaagaatactcttgctggatggtaaacagactattcctagcatgaggtcttttcttggaattattttatcttagtccttacctagaaggacttaggaagtgacaaacagtgctaaaaacctgagagaaaagttaagacatagtgacagaattttgcaggacaaaagagtgatattagtacagtctttcttatgttaaaccttttatgatcttgaaaatcttatctttaaatcttaagaagctgttggattatactttaatcattgcagggaaaagatttagaaattatgttgtcaaccagtttagatcaaattgacatcagaattgggtctttaggaggagatttttggtacaataactttgtaatctgaggatactaatcagggtataatagtacacttaattagtatgattagctgatagtctcaagttaggatgacagtcattgagcccatatcaggtagttaacagtgagcatctatctgttctaatatgttcagcattctgttaggattagttggtgtccatgctgtccttgttattaaatcatctgaatatcatccaagaccataagggactgtatgttcacaggaaaaaaataacaaaatcacaaaatgtgaagaatgtatgtattatgaaaagaaggtaggcaaacagatatctttaaaagaggaagctaaaaaaataaaaataaaagaggaagccaaatgaatggatcagatagaaaaaaatgttcaaaagtgtaataattgttttaaaaggactaaaaatatttttagagacccaaaggaggaaattagaaacatgaatcagaaaaatcagttatgaaggaccaactggagatattcagtatgaaaaacctaataactgaaataactcagtaagtatggtattagataaaccttatagatgttttttagatactgcttttcagagtgaacacacttgaaatacaaattagtgagctgaaagatcaggtcaatcaactcttctagaaggactcaggaaggacaaagcagtgctaaaaaactgagagaaaaggtaagatacagtgacagaattttgcaggacgaaagagtgatattagtacagtctttcttcagtatcttcaaggattggttcaaggacccactgccttcatagtaaaatccaggaatgctcaattcccttatataaaatggcctgtttgctcataatctacatacatcctcctgtatacattcaattatctctatattacatatgatacctaatacaataggaatgctatgtaaatagttgttatgctgctttggtttttatttgtatttttttaattgttaatttggttttttcttgaatattttcggtcccaggttgtttgaatctgtaaatgcagaacctcaagatacatagggctgagtgtatttgatagaaagaggacagagaaattgttgaaataagagaaatttgaagctaggatgctatatccaattaattcaatgtaaggctgaaataagttattgtaaggtacacaaggcctcagaaggctgacaaaaattctgtttgaaaacactttgggaggatgtgctcaagtaagacaaggaatcaatccagaagttaaccaagagatgtgaaaagtgtggaacaagtgaagctttgtaacgtgtttagataaaaaactgccagaggcatctttaatataaacagcttcaggaagagagacacactgtattgctttctttatcccagagattttggagcgtatacataggtgtcatgcatgtcgtatgtatatgtgcgtatttgttggaggaacaaagcccaacccccacccccgacaaaatcccatgagtttatttacacattgtacatgagaatttgcgctatttcctatcttcagacatgatatttaaaatatataacaattagtacaacatagggcactgaccaatcagaatagacaccagccaaactgctagagcagcttcctggatgctgtgcccttcatgtccggattatgagtacacctctggtgggctggggcagaggcatggggcaggggctcaaagtggcttctatttaccatgtatataggattgtttcaatattttaacaacttgtatggtcatgtatactgactgaatagcaactctgctatgagacataagacatgtttgatgacttcatgcaattttctgaaacatgctctttttttttttaaataaaccttgggcagatgttatgttaagacagtctctgtagtaaaataatttgccatattggagaggcttatcatctttacaatgaaagtcagaaaatataagtaaaacatattaagttgtactaaagcagagagaataatcaaatataatcttactcaagatattttcatgacaactcagcttgcaagatgttttcctaggcttactgggtcataaatattcggtatcattttttttcctatattttaaagaaaaggaatttggaacacgtaaactataaatctaagttttaaaaaatctaaacaacagtttcctctcattgcagacctcattcaaattgcaggctggagccatgcccaatatgcctcttcagagccacaactacccacaggtaggtgggcacttggtgagtgaggataaaaagtttgttgttataagtcattgagttgtgcagttgtttgttacacagcaaatgacattccttttttacttattcatcattcattcaacgtattctaaacatataactatgaactataaaaactcaaaactggcttttcttttaaaagactgactagacaaatttatgttaaaactaatcaggaaaggaatggagatgcaaataaacaacagcacctatgaagtttgcattctactattgaaacagaaaatacacaaataaactgggaatcccaaatggttcataagcaaacgaagagtgacttacccttactctgtaatcagagaactgcaaattaaaacaattggaaagtctgacaatatcatgcagtggtgaggatgttgggaaataagaaacctcccattcaacttaagggaaagtaagctgttgcaaccattccagggagcaacatgaaagtacttggtaaattaactatctttatactttctcaatgatgtagcaattacacttctaggtttcttgcacatgtccctaggaatatttttcacagcaatgtttgtggtagtaagaatggagaaagtctagatgtccattgacagaggaatgggaaataaaataagggatagacacataataaagttatattcagcactcagaaataatgttctagattaatatttatctggatggctcttaaaatatcatgacaaattggggaataaacaatatgagatttataaaagaataactttcaaggatattacatgcatatgcccagaaacaccaaattcatctttaaagatacacatatatctaaatgaatatagcaatgatatactggtagggtataaattaaatatgtaagggtggggtgaggtgagaatggtggatgcatgggaaaaaggtagtaaaaagtagaaaggtaaaatttaaaaaggggtattgcacagacgctgaaaatgtgcaatgaaatgaagggtgtgattaattcaattttgtgacttgatagtctaaaaataactatatgtagtagaatctgaaatatgaggaatagggaactttaagggagtatatggaagtcaacgccgtctaagcatgtgcacactgaattctcacactttcgatgatgtcctgctattatatcttttctaagcttagaggaagataaataccacagtagttatattttaattctagttttatttaggtaaatgataataatgagataagccacaaagttcgaattgacatatctattagtattagtatacataaatgtagaaaatatatttcaaaagaaaaaagaacgtactatgatcatcaaaaacctcacctttccacatgatacatattgttgatattttgatatttttccaccatggaatttattttgcaattaccttgttaatcagtataatgtataatgtgaggattaaattgcatctatggatcttgatgtgttatctttagaacttatttagattgaagctttcattttatctttttcaaactactatattaatgatcttgaatgaagattattataggagttcagtgcctcgcaaaattttcttgtacttaccctgtgcttcatactcttattgtcttgcctcctttgaataatcacaaaagaaaaagaaggcaaaggagtatatagcacaacctattagaggaaatggctgaaatagtattctcttaatgtttaatgtgactattaagagggtattatgctggcatgtaaaacagttaattgtattcagtgtgttttaacatcactgattaattgatggcgtagtgaatgttcatcttggagaaaataccacctttgtatctcaggggatctaaagaatgtcttttgctgctgaataaagtgcttcaaaaagttcaaagggagaaatgtgtatttttttttatggtaaggaagaatagattttaccacttgggaaagtaacagcttatgaaatcacgcagtgatgactgtaattcagctgtcgtctgtttctttcaccttctaaccagtgaaaaaagttaggttacttatttctttgactaagtaaattgaaaaggaataaattcagaaagattatctaaggaaactggttattagagcaaaatggtttgtattcactctgtaaatgaatgctcctgctgcttttctcttcattttaatcataatatttcttttttccagttgcttcatgtgaattttattttattgtttgtttttgtttttgagatggagtctcgctctgttgcccaggatggagtgcagtggtgccatgtcggctcactgcaatctcctcctcccgggttcaagcaattctcctgcttcagcctccccagtagctggaactacaggcatgaggcaccacgactggctaatttttttgtatttttagtagagatggggtttcaccatgttggtcaggctggtctcaaactcctgacctcaaatgatctgcccgccctggcctcccaaagtgctgggattacagcttgagccactgtgcctggccgtgaatttttaaatatatcacatttcaaaataattttgcagttccaaaataattattttgtaattcaaagacagttgaataagcaaatcccttgggatttgattgtgtcagaattataaggtcctgcttatttttatttttatttttggaatttgtctgatggttgcagattattgtcaccggttcctcacgtttgttcccaaaagaagtaggatttgtgagacttggttccacctttgattttgatccatccctctgaatcaggctaagtcacagactccctaggtcattgccacaattttataagtaagacaactaaaaataatctatagtactcactttcaaaagatcaatcactcaattcactgagtgttaataactgatttagctcagggagaaggacatttctcttattattctctataagaaggtaaaatatctaggttcttacatttttgaatagcaaagtaatgttgaaattagatggacaccttgacatgaatctgaataaaaataacatatctcaggaatcttttagtattatattattgatataaaaattattaaaataggctgagcgctgtggcttacgcctgtaatcccagcactttgggaggctgaggtgggcggatcacgaggtctggagatcgagaccatcctggctaataaggtgaaaccctgtctctactaaaaatacaaaaaaaaaaaattagccgggcgtgacggcgggcgcctgtagtcccagctactcgggaggctgaggaaggagaatggcgtgaacctggaaggcggagcttgcagtgagccgagatcgcgccactgcactccagcctgggcaacagagcaagactccatccccccaaaaaaaaaaaaattattaaaatagcaatattattaatgtctacacttggtcttagccaaaaggccaagaagatatagtttcttaaatttctgagatctttctaatttataaaatgctttaatatacagctttatttttattaatttaatttaatttaatttatttattttttagatacagagtcttgctatgttgcccagcctagacttgaactcctgggcccaagtgatccttttgcctcagactcctaaatagctggtactaggcgtgcgcatcactgtaccttacctccatacgcagctttttagaggcagaaactatttcactgacttctatcccttaaacccagaaattgccagacataggttaataagtgcctaaagtaaacttcagtcttttgttgctgtttcccacctcctatatttgaggaattctctgcaatatgtatctttaacagaagctccaaaggccatgtgctctatatcccatctttctcttcaactacagcacagtaacgtaacttaggctcacctgatcagctgtacccagttgaactttcactgggagctggtgatgcaaaagagtagcaatggtggagaatctattctgatagtggcagcagtatagatagcaacaacctgttccagggcagtagtggaaatgaaactagtggtggcatacggtggctggtgcctgaggtgatggctgtacatgtggtggcatccagtgttcagccatggtgggagcagtccccttatgaccctggatctatggttttacttgtggatctggctggtgcatagtgctcattgttgatcttccctttttcaaaacttgtttctttattcttcttgacaattctcttagatatataaaatccttttaataaattctgtttaaattagaattggcttctgtcacttgcattaatatacttgacaaataaaatatgaaactgacttgcatagctctataaccctatcaagacaggttttacgaatactgtttatatatcagtaagcaaagactaagagacagtaatttacttggctaagattaacgtttagtaagaacgaagagccaggaatcatacatagtcactccgattctatgcctgggtctctttcttccctatcacagtgtggcagagatgggttaattttctaagtacacagaaagcttacatttcacaacttctcttttaattctcagcatcatcacttggtgtagagtcccccagagagcaacctgatccatatcacaaacctgagacaaattttggttgccttaagcccttacaatttggagtttattcttatagcagctaatgatctttactccaattaatgcagaaattagtaacaaaattgaggtgctgtcataacaaaaacttaaaatacgtgacattgacagctgttagctggatagtgaggagagagataccagagatctatgttatatggtggtaaaatttttggtaaatttattaccttcttacaagacagaaaatgtacctactgggcttgtcgttttagaggaagagtttgcaaaatcaaatgttggcagagtttgttgggaccgttggcttatttggaaaagtgtagtaataaaagagatgttcccagaagaagattgaccaattgatgaacagaaatgaaagtagagagagaacagaaattcagagcttttcaagttgaatagtcctaactttgaaaccctaaatggtaagaaatggacttacaaaaggctttgaatgaaagaagtccagtacaacttgacactaatagttggataaagggactcacagcaaagatcagattagggtatgccttacacattgtttgctccaaatagactcaaaatacctgccattaagtaaaaagaggaaccacagtggcaaagaagcaacacagatcagactagacaatcatttctaggaataaactattggtatagttactggcacgtggatttgattggaaacaaacagatagaagaatataaaattttgaataaatgattttgccaatggagtcatgaaattgcaataaaaaaacacgtaagatatcagaatttaacacaacctgcatgtcctagaccttcaagcaggtggcaggcagtaggcagtagacttgcacattcatatagctgccaaaaaggtcatgtgccccagttcccactgcagatgcggtcaaggagaataacagacagggggataccttccagagggtgaggacattgcataaaagaactctctccagaaggcataaacagtgcctaatgaagaatttctcctgtccccaaggcaatgtctgcccaatgggattttaaaattgccccaaaccagttgctgtgtttctttttccccttctaaatggaagcgtctattgtggtaattgtaacccttctccaccgttgtaattagatatgtatttattgtctttttagttcataggtctccggagcctggggcatcgcatctagatggaaaggactgaatatcaactgaagagcctaaattttgggctgatgcagtcagtgattaagagttttgggtcagtgatggggcgaatatgtttcatgtgtgggaagataaataaaaggggtgatgcatgaccagaaaggaggactgtggcagaaacagcctagatgctcaccaatcttatttctactgtttgggcagatggaaactgctatagttcaaagcctctcttggagttagattgcaatcatatgaatgagaaatagaatgtgagcgaaactcactggtgtcacttccaaacttggctctttaaatgttcttcacaatcattcatgtactcactctactgtcttatgactattgtacatattcatgcacataatgatgtttccatacatataatgtgtaataatcagatcagggagagtcgcatatctatcagctcaaatgtttatcatttctctgtgttgggaatgttcaatatcttccttctagctatttgaaactatatattattgttaactcctgtcatcctacagtagtatagattattataagttattcctcctatctagctgtaattttatatcctttaacaaatctctccctgtctctcagtaaagtatcctgagatagtggaacttctctggttaacacttggaaaagaattgctgaaaagagccgtctcaccaactttgggctgtgattttgttttgtgaagtcattgtgattttgggatggttgtttatagcagctagcaagtcttagcatggcaaatacagtaactgtcatactaaaaaatatgatgcagaataaattatgttaggtagattaaataaatctatattattaataaataatatttgtaagtctgaattttatctgttggaatgtcagaaaagaatggggattatataaaaaagaattgttagaaaccagagtgtatcctatataggatcattagtgaagaaatagatggaaaagtggaaatgaataactatttcttccacacagaataaaacccagaaacaaagaaaagttaagtagtattagatagtgattcccaagcctgggaatgggagtcagtgatactcacctaggagagaatattaggaaggagtgagtgacatgaaaaaaaagtcacggagggaaagggtaaagttttagtaagtcctatggatgacaattatgtattacctgcagcttgtcctactagaggaatagtctctgtgccaagaggaaaaaaaaaggctcagaatttctgatctaagacataggtaattaagaactcaaaaggaaaaatgtagtcagtgtataagatgatggaaatcttgttttaagagaactgaattattggagaatgtgtaaagaagaaagaggtgttaaacttttgaaggggagtcagatttgctcacatttttaacctttaacagtttcccacttttttttttgaaacggagtttcactcgtgttgcctaggctggagtgcaatggtgcgatctcggctcacagcaacctccacctcccaggttcaagtgattctcctgcctcagcttcccaagtagctgggattacaggcccgtgccaccatacccggctaattttttgtatctttagtagaaacagggtttcaccatgttggccaggctggtctggaactcctggcctcgtgatctgcctgcctcagcctcccaaagtgctgagattacaggcgtgagccacagtgcctggccatactttattctttatgatacaatgtctcactctgttgtccaggctggaatgcagtggcagaatcacaggtcactgcagccttgacctcctgggctaaagtaatcctctaccccagccttccaagtagctgggaccacaggtgtgcaccaccacgcctggctaatttttaaattttttgtaggtatcactatgttgcccaggctggtcttgaactcctgggctcaagcaatcctcccatcttggcttcccaaagtattgggattacaggagtgagccactgtgcctggcctggatgggtaacctttgaaaagttatgtaaaatctgtgtgcctcaatgaggatagtaatagaaacttccctggaattacttgaagtttaaatgagttaatctatgtaaacaacctagaacgggccgggcacagtggctcacgactgtaatcccagcactttaggaggccaaggtgggtggatctcctgaggtcaggagttccagaccagtcaggccaacatggcgaaaccccatctctactaaaaatacaaaaactagctgggggtggtggcacatgcctgtaatccccgctcctcgagaggctaaggcaggagaatagtttgaacacaggaggcagaggttgcagtgagtcgagactgtgccactgcactctagcctgggcagcagagagagactccatctcaaaaaaaaaaaaaaaaaaaaaaaaaaaaaaaaaaaaaaaaaaaaagaacctagaacaatggctggcatagaggcatagaataagcattatatgtattagctatgattacaaaagaggaatctataaggtattctgcagacaaagagaaggaagtggctaatttagtctgcagagtagagaagaaactcagagagctgcaatttgcaaagcaaggaggagagatgaatatttgttttgttttgttttttgagaccaagtttcagtcttgttgcccaggctggaatggaatggcatgatcccggctcactgcaacctctgcctccaggattcaagcgattctcctgcctcagcctcccaagtagctggaattacaggcactcactaccatgcctggctaatttttgtgtttttagtagagacggggttttaccatgttggccaggctggtctcgaactcctgacctcaggtgatccacccgcctcggcctccctaagtgctgggattacaggcatgaaccaccgtgcccagccgagagatgaatattaaaacatatttgagggactttagaaattgtcagtctttaaagtctgtaagaaggatggtctggatgactcctttagcatgaactcattatttagtagatgactccatcccagttagtatttatgcctgtggaaatctcatatgaagagctagatctgatcagcagctctattatatctagcttaatgctcacaatttgttccacaaagccattctctctctctctctgtctttccctccttccattttgttagatcacatattataatagttatatgctttaaacccttatttggaacaataaagatgactgacttacatttcagacattgtcgctccatgtcgctagttttaaaacctgcccaacttagtaataaaaagtaatggctcctcagataagagtttcatgatagtttcttagaaacgagtcaatgacactactgtaatagcaggggaaaagatttctaagtcacatcatattttcaaactgacaattttagctacaaaagtacaacttccaagaggtctttcccaggtaaacatggaagggatttaccagtccacagaaaagtgactgcctctcccttggataaatgagattctttgcttcctgaaaatgagaaactgctatttcaatttcaatgccaaagatcaaattttctgactactgtgaatgaggctgctcagcatttacaacactaaaaacaaagaaaagaaagccgaagaggaacaatttttttttagcatttgccccaggcctttgcaatcaaagcataacccagcttatttttggggtgactacaccctccattctccaggtagttgaatcttccttgcatgtgtgaaagcatcactgacaaagtttcgttgtcatggagtttttagataagtatctctgagtttaaaatcccaaattatatgcatccacccacccttatactataattaatatctgtcttggggctttttagaaataactacacacatcaacagtttcacaactgcttctgtgagtggtgagattagtaggcagatttctaggggaattatgcaggtgaccagtcattaatatgcacattgttaaaatgtttgaacgttgtcatgatgatgatacagcgccgatgagtggaggaacaccaagttcttcgtcctcatgctggtttagataaaacgacactgacacacgtggagtggttttaaggagcggaaagtttaataggcaagaaagaaaagagaaggcagaaggaagaggctctcctgtacagagacagagggaggggggctccaaagccgagagagggaaccccatctggcagggataccagccaggtatatatacagaggctggaggaggcagtgtctgatttgtatagggctcaggggattggtttgacaaagcatgtcattcatatagcccaggaaaaagcctgccctcccaccctagccttttaatatgccaatgcagggcaccatgatgttctacccacgtggggatatgtgggggcggccatgttgccaggaagtgtggggcaaggtcaagatggcagtgggaatagccatgtttgggtggacccagtttctaatggatggcatttgcatatcaaaggttgccagcctggctctaagagctgctttaaaaacgaaaacttcccaaggaccccttttcctctctatctgcctaaaataatttcttaataactcctacaacaatgacaccaaggggccaaattctaagattccaccaacatgatgcagttggcttggcacttcataactcaattaaagggatttttgagggttgttgccttaggtgtacactgcatgctttgaagtttttcctcataaagaacataatgcagtaacttaggagagaccattaaagcatttttccctttaagaactgcagcaataattataatctggtagctactttcttatgttcttgtaagataactagtcatcaacaaatttttttctctattaatttcactgcgatcaaatatttctcaatgaaaataaaagataggaatttcctgtatatatataaactcagttattttgaaacaacacataacattagaattgagaaagaccatggaaatattgatttcagtgtgaatgaaaaagaaaaacttgggaccttaattcactatgccaaaaaagaaaaaaattaagctgaaagatgagtcatgcaagaaactgcctttccttttgttcctaagcagatagctacagataaaagttaaacatctccactgactgctactccatgttcaccttattttatgtaaagtgccgatttactgagcccaagatcaatacttaactgacaattcccctacttgttcattttcctctgcagcttgtggattaccatactctccccttttcccctccagctggcttttcctctttaaatattgaagcctgcaaattcatccttggagaaaggcacagaccacagactgcttctgttattccatgttcatttcttcctggcatgtccttaaccttggcaaaacaaacttctaaatctatttagatcacagaaaggattttttatttctatacttctttaatgtgtttttaaatgtctgcctaatagttcatgcagttgatattccataatctcatcatgattgagtttatttctcagctgtatagaagaggacacaaaggaacagaaaaggcaagtatctcatccaggatttcctagctagtaaaatgaatgcaggaaaaagggaaaggccaagaacagtcacatctatctgtcttttcattttgtttcttcttttgcttttcatgcttagaaattctttctccgcctagagatgagatgaatattcaattatggtttcttccaattgtttctggtgctcatttttatatttatatttaacctaagataatctggaatatattttggtagaacaaataaattagatgtttgttctaagagaagtcttgatgaaatgattaaaaagtttatctataagaattaacagataatacaactgagaaatctttaaaaggaagagtactggaacaggtaacttgtactgacaaaaattgaaactgataatcatcgtaacaattagattagcatgcaccgttttaaggaaaacaagatcaattctatttagcataaaagcagcaattaaaatgatatgaaaatctgtttttctcagacagcatattagtttattaatttagtatttgataattttttcagatacagataatatctaagtgataatttaaaaaaatccaaacatcctaaataaaaatctaagccaaaatctcataacaagcctgtctcttaatgagctgtgacagtgaaataatcctttttacatggtgatagctgatattgtgatagctgtaaacttagctgtcatcacagatcttggctacagaggctgctgtggtaacgagtgaacctaatgggctttgtttacttgagtgaggagttttcttcatgccccaaccctgcctgcttgcaatgtgcatctgaagccaggaggatgtctctccaactgatcgtatatttctttcttgtttttcctttttttttttttttttttgagatggagttttgctcttgttgcccaggctggaatgcaatggcacgatcttggctcactgcagcctctgtctgctgggttcaagcgattctcctacctcagcctcctgagtagctgggattacaggtgcctgccaccacccctggccaattttctgtatttttagtagagacggggtttctccatgttggccagcctggtctcaaactcctggcctcaggtgatccacccttctcagcctcccaaagtgctgggattacaggcatgagccaccgtgcccagccagatcctactatctttctacttttgaattgcaatgtggtttatgtctttggattttaataagcacaaaactcctcctagaattagcaagatatcaaaaaaggcctccaagtggagagcatttggccttgacctcatgtaggaaagaaaggagttggccaggtgtggtggctcctacctgtaatcccagcattttgtgaggcagaggaggatggatcacttgagctcaggagttcgagaccagcctgggcaacacaacaaaaccctgtctccacaaaaagtacaaaaattagatgggcatggtggtgtacgcctgtaatcccagctagtagggtggctgaggcaggtgagttgcttgaacctagaaggcggaggctgcagtgagctgagattgtgccactgcactctggcctgggccacagaatgagacactgtctcaagaaaaaaacaaaacgaaacagggagagtttgaagaacaataattctataattaaagtgtttttagaatagccctcaaggatcctctttctatcttttatactaccaaacctataaacatatatgtggtttccaggatgaggaacacaatacttgagatggaaaactaaagaccggctatgagctccaaggttgaggaacatatttgctgaacccttttccttaaattacatttatagaaataggaaaaatggaatatctccattaggcataatttaaaagcactgaagaagtgtagggatgtgaaaacacttctaaaaaagcaagcttggcaaaataccaacttttctcgaggaaccaatccattctatttttctgtttgtttgtcccaggttcttaagcagcatctgatttctaaactcttacaagggtagtctggataaagcacgttttattttctctgttgaaaactaagtattgcttaaatggagaatcatgccttatttggtagtacgcaaaggtttaaggcattttttttccttagatgagggatatcaatacagaaaagtctgtcactctgttttaaaatttatataagctcaaagtttcaagtgctagttcatgggggaaagaatttgtttattttttgtttttgcattttctatgacatcttttagcataaagccttacagagatcatttttttaaatagtagaaacataaatgcttattgaactgagcactctagccaaggaaaaacttttcattaattttgagataagaggcaaaaatgaaagcatattataaaccttactgattatttcttccttactttggctattggccatcttttagttgaagcatatacatttattaaatgtattaataaatacattaaattaataaagtcccatattaaagaagtttatggaaagatctctccttatgtcttagtgttctcttccaggaagagggtatacagactttatagaaagtagatattccctcttatcttgtaatatatgtccttgtgcagcatgagaagaaaactttaagatcacagactagcctaagaaaaatgatttatctttcagcaaatatttctcatccataatttactttggcttacttctgtgtctacaagtgtctgttgtagcatataaatgaaactagtttcaaacaacttttcaggtgcaataacaaaatgtatgtaccagagcttctggatagctgaacacatgtcagttcctggagggcggtgtgcccagggatggcatggaagctctgtgccccttcccctatgtctcaccctatgcacctcttcatctgtatcttttgtaatatcttttatttactttttttttttagagacaaggtcttgctctgtcacccaggatggagtgaagtggtgcgatctgggctcactacaacctcctcctcccaagttcaagcaattctcctgcctcagcctcccaagtagctgggattaccggcatacaccaccatgcctggccaattattgtatttttaatagaaacggcatttttacagtgttggccaggctggtctcgaactcctgacatcaagctatccgcctgcctcggcctcccaaagtgttgggattacaggcatgagccaccgcacctagcctgcaatatcttttacaataaaccagtagatgtaagcatttccctgagttctgtgggctgttccagcaaattaactgaacccaaaaaaggggtcatgggaactgcaacttgaagcgcggtggtcagaagttccagaggcccagacttgcaactggtttgtgtgtagttggcagtcttggggatggagccctcagtttgtggaatctgactctatctctgggtagataggattggaatggaactaaagaacatccagctggtgtctgccgcttggtgtgttaggaaaaaactccatgcatttggtcatagaattcttcttctgtgttgatgactgttgtgttgtcagaggagagagaaaacacagttagggagagttcccctacacaattgatgtcagtgaaatgggatttgctagaacagccctcactcacagaaacatgtggtttaggaagagaaaggctaaaaggctgggaggatgaggaatctttgattcctgggtgaccatcgtggtcacccatgatatgaagttgcagttgtgttgagatcagttactacaggtgaaagttaccagcggaatttagagatggatagaactccccaggaattggttcactggatgcaaaagggaatgcaaactaataagaaaaaagcaaaatattcagttctttggttgttgttacttaaaattgctaaaatgaaagtaaaatagggtgctgcatcaggacttgaagttggaccaagttcagatggggacatgtctgagcttagttaggccactagcctcaaagtcacacacaaaggagaaaattatgcagggacagtagaaagtacctctgaaacctgtggaagacagtcaatgtgaaggcagggcaaaaccaagtaactatttaaactattagagtaggtagttaggtaggcatgagcaggacaggagcgaggccccatccagaaatgccaggcaaccatcaggtgatggttagttggttgttaaactgttgctctaaaataataattgttcacagccaatgcagggaaaaacagtctcccaataaatagacaatacctgaaactggtgatcagcagcttcctgataagatttcaggagttgggtgaacaggctcaagaatgcccactaaaaagcaaaatggcagagattaactggtatatgatctttctctaggaaaacttgactggtaaggaaaaaatgcctcaaatgagcatgtgtacaactttggcaaacacagtgtgcatgttgcccctccccaagtgctggcggaccagtgtgcatgcagatagcccaccccaagggaagaatcaggggagaagaaatgcaaaccttggaacgatgccaatgtattctttcctccttgcaggcaagaatcgtttgctgcagacctgttggattcacagctggtaacaaaaccggagagtatagtgtgaaggaattgtttcatttttgtagaatggtgttatcagcttcctgaggaactattgctaaaatggattataagaatgacaaatgtaggggcagtgtctttggtttcaaatcttgcagagtgaagagcatgtttgggttgatataggacccacagctgaccatttgaacaatcacagatgggtatatatgatccagatatgtaggttattccgcaaggaacagccagtctgatagattggataaaagccattataagatctatttgagaaggtggactgttgaactccacctataaatgccaagtggaacaccttacataaggcagctgatacaattcatatgcaagccatgtgtgactggctttatgaggacatgaatattcactcagtgaatatgtccattacccaggtcacggtaaatactctggttaaggggaccccatgtgacattactcctgcagactcaaatagttcaagaagccttatcaaatttgtggactgagtttcccctcatggatctcacagatgctaataaaaacattaggttaattaataagagaacagtgaaaggcaaaagggagagtcaaagactcatccccggaagatagaaattttaaaatggttattaaaaaataaggtgaatgaagaaaacattgatggggtgaaactaagaagaaaaagaaaggggagagtcatgggactcgtcccagcagaatggaaaactttagatgcttattaagaaatagaatcaataaaatagacattgatggggttaagcaaaggtcttaatacaacactattgtaggttggatggaccagagggggccccatcttgttccccaacattaaaaggccgcaaaccagtctgctgtatttctgccagcttggagaaatttaaaaagctggaaggcagagattacaatgaaaaatcagatctaaaattgcctggggcaacagtcaggcagactaatcgagataaagattaataaaagggccagggtccttgggctcaatccttggctggggacccaaagctttttacacaagagagggtaaaatgacctgggggtaaagaagagaagatcctgaaactagaacataaaaatgtaagagttgataggactatggaagttggtatatttgaaaacactttatgtgaagtgattgcatctcttttacctgatttttttttttgtgggaatgaacaaagtatctcattgggaaatatttctcctccctggtgctgtaaaacagaaggcatgtaataatctgccctcaagcaatattaattggacatgctaaatgggaaccagtgagattgcccaagtccacacagtgcagagtagaagctagaatgctgttatggataaattctccacttgataagcctctgtgatgctatttcctggatcttgtggcaaaagcctctgagcacctcccagcaacatctactgggactttggactatggaacttccatctgaggggcatttactgctttgctgtgaaatgttaggtgaagctaccgctattaacacctgaaatacccatgttggcccagcgatgtcagagaaacattctaacagggatggcagtgcccaggagagttccataataaaatggacatggtttatcgaggatcatgccacctaagaactgcaaggaggggatactcttgagcagggtgtttcttttctcctgagactgactctggaactgtgtgagaaactgctggattctacagtgcctgataaatggctctcaactcatgagaaagagctacttagtttgtggccggtaattccaaggtaaatggacaccattgtgtttggaaggcagctactttgataaaagaaggtaaaaacagatctgcttggtgggctgaattgcacactgtttttctaacagtgatggaagaattgatcaatggtaaaagcccctgagtttgggtgtttactgagctgtgggcagtgtgacccatggcctggccatacactcaggcaagagggccatggaaatttggcctattaaatggatgcacataggagcactgttctatggagatttgaggggtgcattaaagaagaacaagtgaatgcccatcagaagaactcccttccaggttcagaaagtgactggaattgacaagcagatatccccatgtactcccttgaagtggccacctgggcctttgaaatgagtggatatgggggtattgtaacagggcagagatgggctgaatgtagagatggtttttttgcaccttctcaggcacaaaatgccagaaagaactgttgtgtttctcaataagaaagccagagactgctgacggctttgggacagattctctggtgggaaggccctgaacatagctggcaagtgcgacaaatgctggtagccctggaggctacaaatgggtcttgacaggaatagacactggctatggagtggatgttgcttgcccagaagaagatgaaaattctctgagtgccataaaaaaccggaacagaagatattacatggatatagatggctaaccatcagtttttcagaccaaggaacacactgtacagcccataagaatagtccaacaatggacaaagagatatccacctagagtaatagtttgatagagcagtagagcaggcaattgaaacattgattgtgtaaaacagggggagataaaagcacaaagggctggctcacatgccttcctgtctgctcacactcaacatgagcaggactagagtgtttctgctagattttttttctttgtttttctggttgatctggggaacagggagttgggaggatgctggtatgactatgccattcttgccaagggacgagtacactggtataacaaatgtaagtttttctttcttccccaaatcacctaaaagaaatttatttttttctcccctggctgatgcagtggtcctaggaccaggactgcaattacaactgctggattagcaggggtgatttctaagcaaaaacctgtaactgtgttttgaaaccttatatcaaaattcccaaaggcatgatgggagtgggttgtgtcttcatgctatctagaaaaattggggctatcagtgaatgcagctatattgcctggtggtaaaaatagctcactagttctgcacctatgtaaccttacccggtctgaattggcgtggactgaggaggagctaattgctagacttgtattactacttgcaacgtagaccggcactgtggtggttctaatttctcttccaaaggtgaaaaggtttaggtattaatggagagaaggagaaatagtagctgagagtaaataaatgaataaatgagttattaattgagaaaaattcagtattacataacaactcaaaagagtctcagagcaagagatgacattgtctcttagcttaattatcccagatgccttaaagggtgaagctgcgtatttactgaggccactcctgctttcgagacctgacaagattgagaggaaacttgcaaccctgagtggcctcatcctggaagacattcaaacaatatgaaggatttgattaattgttaatgattgtgcataatatatatatttttgaagtaaaggcaccatggtggaaaaccagggagtggcctgtggtgttatgatatacactggttttagtccacagttcctggcttataactcctatatcccttgttacaatattttcttttttttatataatgttgggtatgttaggcctcaggagcaagcctctgaccttctcctgccttactttcactctaatgtttccccactttctaattgtgacgcttaagactctcacaggagagggttccatcctatatcctgagggaaggaatgctgatgtcatgaagctttcataaaaacccaagaggacagggttcagtgagcttccggatagctgaacatgtggcacttcctggagggtggcgcacccagggagggcatggaagctccgggccccttccttcataccttcccctatggttctcttcatctggatcctttgcaatatcctttataataaaccagtacatgtaagaaaaaaaaaaaaaatgtacttacagtttccttccttccttccttctccttccttccttccttccctccctccctccctccctccctccctccctccctcctttctttctttctttctttcttccttccttccttccttccttccttccttccttcttccttccttccttccttttctttcctctctctctttctgacaaactctcgcactgtcaccaggctggagtgcagtggcatgatcttggctcactgcaactcctacctcctgggttcaagctattctcctgcctcaacctcccaagtagctgtgactataggcacatgccaccaagcccagctaattttttttgtatttttagtagagacggggtttcaccatgttggccaggatggtctcatctcttgaccttgtgatccacctgcctcggcctcccaaagtgctgggattacaggcgtgagccaccatgcctggccaacctacagtattttttctaaggccatctctagctgcatacttaccacactaggtaaattttctgtaaaggcatatgccataaatcaggatttttttgttgtggttttttggtcaagattagtttctacatatcatccagtatttgttacgtctaatgagaggttgtatatatacatgtgaatgtttcaggaccatatggcaattattccatttaaaatattgctgtcctacttctcagaaaaaaggcaaggcataaattattgtttttactattttaaaaaatgtagcccttcatcagagcttagatctataggtataaattactaatgctcatccctttccagtggcaaaaaggagatatcaaattattttgagatttgagtaagaataaaattaataaatagcaagaggacaggtgtgtgaaagttttcatatgagtaacgctcgggttacttatttctttccttttaacaagaattatttagcccttgcctggctcttgctgcagtcaatttgagaggaaaggacatcttgccattgattttaattattcccagtcatcccattccttttttagtagattgaaactctcttgggctggttttctagctccacctacgtattggttggcactgtcttcatttaattttgcctgttattattccttcataatgcctttccctgaagtgacagaacatccttcacctgccaaggtcagcagtttgctacaggagatgacacttccaggatcatatgccaagtctatgtaagggcacaagcgaacggtggtggtaactaatagtcttaaagttatcttgtttattcttatttcagctttcctgctatattttttgcatactctctaaagtaatacatggtaattggaaaaatgtgagaagataaaaaagaaaatcagagagaatgagattgtgtattaattagttatcaccaaacaaaactccagactgtataaataccaaacaaactccagactgtataaaaagtaaaaacaggaaataatcatttcaaaatttcattggattaatgttttctattcctgcattcttccccctccttcttacctcttcctcctcatctttcttcttttccccatgtcaagtaatttccaagatggcccaggaataaagatatgcagttacaaaacattctagccctaactagtaagaacaaatattctctttctgtgaatagaaaggatagatggatctgtatatacacagacttgcatgtgagtttttagaatatgtacatcagttagattgtgttaaggcacaaagccatagagttatgccccacattaggaaatacttccaggaatgtgtattgcatgaataaataaatgaaccaatagcttactatgtgtcagattctttgctgtcctttaaatagatgatcttattgaatcttttccccatattaggaaatacttctaggaataagtattgcatgaataaatgatgaaccaatagcttactatgtgtcagattctttgctgtcctttaaatagatgatcttgttgaaaattcactgtgaaaagaatggggatctagcatgataaaaagatacttgttgactttatggcaggacacaagttacacattttgcagacttaagagaggctgtgtggcctgaattttgaagtagtacctactgctatagtagtgggcactcagattttgtagaattaggcttatcagaaatcctcagtttaattgtacattctatgcacttaatatttgagatttgttacattgtattggtgtctaatattttattcattccctatgagtgccagaaaaggagtgaaggtagagaatatttcatttgtcagtattccatgaaactactgattatgggaaattcatgaaagagcttacagtttaaaattctacaatggattaattaaatatatatatctgattacagctgaagttcaagtccctcagatcaatcagcagtattttcagagataagtagatttatttcttaattaattaattaatatttatgtgtctattaaatatggttcttcattgcacatactttgaaattttttttcttttttagagagagtgtcttgctctgtcacctaggctggagtgcagtggcgcaacctaggctcactgcaacctctgcctcccaggttcaagcaattctcatgcctcagcctccagaatagctgggattacaggcacgtgccaccatgcccagctaagttttatatttttagtagagatggggtttcactgtgttggccaggctggtctcaaactcgcaacttcaggtgatctgcccacctcggcctcccaaagtgctgggattgcaggcatgagccatcacacctggcccatactttgatatttttaaccatcaaattagtgaataaattactgaataaaacttaaccatatctcttccatgggtagggagactatggcatcacaaaggaacagtgttgttatatctttacaataggaaacattggacaaagatggaagagtaaggacaatgttatcattttcattgttccatcatcataatgtgccatgttgtgtatagacttctctacactgtgtggctgcttctttggaatacacagtcctaagcattgctgggattgtgaatgtcaaactactactatagatattttgtatctcagaacttaaacttgatgcagtaattattgtcttaatcattggttttacccttcctatcattgtgttggaataaggtctttcctgaagtgagtactataagcaatagtatagaaatacacaagagacaataaagtacgtgaggaaggctgggcacagtgggtcacacctgtaatcccagcactttgggaggctgaggcgggtagatcacctgaggtcaggagttcaagaccatcctgaccaacatggtgaaaccctgtctctactaaaaatacaaaaattagctgggtgtggtagcatgtgcctgtaatcccagctacttgggaggctgaggcaggagaatcacttgaatttgggaggtggaggttgcagtgagccaagattgtggcattgcactccagcttgggtaacagagtgagacattatgtatatatatatgtgtatataaatatatatgtatgtatgtgaggaggataatagttaatcctaacagattaacttggaatcattcaataagtagactgaactaaaattgggaagccattatttggtattaaattatgggcaccaggggtaaatgactgactaatagagcaggaaacaccagacagagaaaggaatgaaatacaaatgatggtcagtagggaggaggtggtcaaggaaaatgagttatgaacagaaagaactctatttacaggctgacactataaatgcttgtaaatgaaaaataaaattctaaggcctccagtgaactgaatggaaccctcatcttggccaagggtattccaaagttaacctgaaacactagttcaagccatgacgggaatgagtggtcagacatgcctcattataccctcgtcctgttggaattcagtcactactgaccagcattaacattaaaacagagaccttggccggatgcggtggctcacacctgtaatcccagcacccgcctcagcactttgggaggctgaggcgggtggatcacgaggtcaggagttcaagacctgcctggccaagatggtgaaaccccgtctctactaaaaatacaaaaattagccgggcatggtggtgggcacctgtaatcccagctactcgggaggctgaggcagagaattgcttgaacccaggaggcggaggttgcagtgagccaagatcgtgccactgcactccagcctgggtgacagagggagactctgtctcaaaaaaaaaaaaaaaaacagagtccttaagacaacgaagggagacactgtagcaataagagaccaacatagcagacagcaggccctgaagaaaactgaaatattttaccccaagatatatttctttgacatattttgaaatggccctgcaatggtgtctgttgtggggaaaatccatattctgtaaagaattcccttccttttccaagtctttttcctgatccaggagagaattaactaagaatttggcacctttttaagtctgatgagaaatatttacagtgtattctctctgaagcctcccatctggaggctttatctgcataataaaagccttgatctccacaacaaccgcttttcttaacccagacactcccttctattgattccacgcctttagataaactcttcaactgtgaatccacctatgacctgaaatcccactccccacaagccctcccaaccaagttgagttgtcccacctttccagaccaaaccaatatacatcttacatgtattgattgatgttttatgtctccttaaaatgtataaaaccaagctgtagctgaccaccttgggcacatgttctcaggactcctaaggttgtgtcacgggtatgtttttgaccttggcaaaataaacttctaaattgtttgggaactgtctcaaataccctttgggttactccctgaactatgccagaaaatcattgacattgtgaagggaaaatatcttgggtcccccaaatcactaagctaaagggaaaagttaaggttgggaacctcttagggaaacctgcctcccactctattcagtcacccctcttctcactgagataagcgcatatctgattgcctcctttggagaggctgatcacaaactcaaaagaatgcaaccatttgtctcttatctacttatgacctggaagccccctccaagcttccagttgtcctgcctttccagaccgaaatgatgttcatcttacatatgttgattgatgtctcatgtctccctgaaatgtataaatccaaactgctctgactgccttgggacatgtcatcagaacttcctgaggctgtcatgggctcacatcctcaaccatggcaaaataagctttctgaattaactgagacctgtctcataatttgggggttcatgttttggtaaccacagagggattctaagtagaggtgcccctgacctttgacaaatctccttttggtgtttggtatcagcttgagctatctttatggctcaaaccaataggataatttgctgaggtctggaagcaccctctccagagaatccctgatcttccaaaatttggttgagatctacagtttattttggtacgtaactcctttttttgaattttacttgcttccaacccaaggaaggcaagttttccctgcttccataatgatggaaggcagataactcctttatggagtttgagctcacttccaacagggaagatgagtttttgttgttgtttgtttatttgttttgagacagagtcttgctctgtcacccaggctggagtgcagtggcacgatctcagctcactgcaatctctgcctcctgggttcaagtgattctcctacctcagcctcctgagtagctgggactataggcgttcaccaccatgcccagctaattttttatttttagtagagacagggtttcaacatgttggttaggctggtcttgaactactaacctcaagtgatctgcctgccctggcctcccaaaatgctggggttaccggtgtgagccaccgcacccagcctgatgagatcccctccgctgccccctacttctaggatggtagagagcagccttcagcctgaaatccatccctaggcaagtaaatgatgtcaggcctctgagcccaagctaagccatcgtatcccctgtgacttgcacatacacatcccggtggccggttcctgccttaactgatgacattccaccacaaaagaagtgaaaatggcctgtttctgccttaactgatgacattgtcttgtgaaattccttatcctggctcaaaagctcccctactgagcaccttgtgatcccccactctgcccgccagcgaacaacccccctttgactgtaattttcctttatctacccaaatcctataaaacggtcccacccttatctcccttcgctgactctcttttcagactcagcccgcctgcacccaggtgaaataaacagccatgttgctcacacaaagcctgtttggtggtctcttcacacggatgcacatgaaaaatgaagtggggtttgtcttggttaaagttaagatttccaaccgcctgatcttaatttctccttaccattagagtgcttggtaatcatgtaagttgtgcaattgtttgttttgcttaacttttgttttgttattgttttttgtttctggtttttgttgttgtttcagtctttttctcattgggtttgatcaactctatccaactagatcaaatccaaaggaagttccaaattatggaacaaggcctctgaagtggctaaattcccagaaaaacgacgacaacaacaacagcaacaacaactacaaaaacggtggtgtggtagcagagaaatataccagcaaaaggaaaaaaaagaggaaaggctttgattttgactactaataggctttatttacatagcaaggtggcctttttgctaatcaggccaaactgaaagagcaatggctattacttctgaaatagcagcaatttgtcctagctgaaatatggtaatgatatttaaaaacatattttttaaaggggctcagtggctagtcagcttaattaaaagctaacatccaagatgtgtgtgtgtatgtgtgcatatgtgtgtgtttgtatttaaaagaccctcatgcttttgtttttgcttttctcctaggaccttgtctctttttcgagcaaaagttttttcttctcagttgactgaattctgttttcttcacttgtttgtttctgctctctctcctttctcttgcaccctctgctgcatggggaacctaaaatagttcgtaatagcctggggttccttaaagaaaacagtgaaggcaccagactcccttcggaggagaaacctgtttttccttatggaaccccaagaatgcaaacagacaaggtcctctcagctcttaaactgcttactttttttcactcacgtccgtgtgaagagaccaccaaacaggctttgtgtgagcaacaaggctgtttatttcacctgggtgcaggtgggctgagtccgaaaagagtcagcgaaggcagataggggtggggccgttttataagatttgggtaggtaaaggaaaaagggaggttgttctctggcgggcaggggtgggggtcacaaagtgctcagcgggggagcttttgagccaggaggagccaggagaaggaatttcacaaggtaatgtcatcagttaaggcaggaacaggccattttcacttcttttgtggtggaatgtcatcagttaaggcaggaaccagccatctggatgtgtatgtgcaggtcacaggggatatgatgtcttagcttgggctcagaggcctgacacttttgtattgtgttacctggttttttgtttttgtttttggctaacatagttattgcaacagagtttgctcttgggtttttaaggaagagtgtgttttagacactagaaatgtctttgcttaaaaaaaatttttctaagtgcacttaaaaaaacttaaaaaagtatcatgtggtctaaccttattataattctcccattctggagaccctggaatcagtgtgggctctgcccacagctcagggatccagttaaaagataggtagttcctatctaaataaaactggtctccttatccaatcttacgatagatttctgtaattttatgtttgatttggcatctatctttaatctccctctagcatcaccagactttttctctcagtaccttgtgatgtaaattttgctatttgcatttcacctgagtcgtttcctttaatttgcaaatttaagcgtgtttacctgacaactgcctagggttgtgaaacagattatcaaaaatctgaaagtctaagatagggaaaaaaaggtttttataaatctataagatgtaatttatcagcatgcctaatatgtctatgtatttatatgttatgtacagaatgtttcactactcaaaatagataaaagagctctaattaattggcttaagaaaacaaaaatgcttgaatcaaatactttattggaaaaaagaaaagactagtcaaatgcttattcaagtttatgtaacttaagtaaaatctttaataaataagctagctttaaaattattggtaaagtaatattagaaatgtcttaagaattgccagcatacatttttgttttgtatttattaatcaagcaatttcatacttatccctgtcaaatgctatgaggtgtcaaaatttggcatagtggttacaaaactataaaaccagcccaagaaaatgatctttccctgtgtaatctttaaataaattagagattgatattggtgtaataagctacatcattttattttatttatttatttatttgtgtttttttgagacagtcttgctctgtcaccgaggctggagtgcagtggcacgatctcggctcactgcaacctccacctcccaagttcaagtgattctcctgcctcagcctgagcctcctgcctcagtccggagtagctgggactacaggcgcatgccaccacacggagctaattttttgtagttttagtagagatggggtttcaccttgttagccagggtgatctcaatatccttacttcgtgatccgcccacctcggtcttccaaagtgctgggattacagtcatgaaccaccatgccctgcctttatttactttttttgagactgagtctcactctgtcaccgaggctgtagtgcagtggcatgatctcagctcactgcaacctctgcctcttgggttcaagtgattctcatgcctcagcctcccaagtagctgggattacaggcatgtgccgccgttcccagataatttttgtattttttgtatagacagggtttcgccatgttagccaggctggactcaaactcctgggctcatatgatttgcccgcttcagcctcccaaagtgctgggattataagcaggagccaccaagccctgccaacatcttgaatttagtaagattactgtgacttctaatcttgtggcttttgtcggtctagtccacaggcagtaaggtttgttttgggaaaggactgttatcatctttctttcaaagctaaactataaactaagttcttcccaaagttagttcaaacttttatcaaagccaatttaaaagcctatgtaaaaaaataattattcttgctgagctgtatacaaataatttggccaagtatcataaagcaaatgaatcctatcatgatttgtcttgagtaaaaattaaaaactggagagagaataactgtgtttcaaaacctatactatacctgttgttagattctaggtcttgcctaatgtttttcaatttttattattttctacagtttggaccaaattctaatttttcttggctacaagtcttcaaaataatgttctcatttttttcttcttttttttccccacttttcctaatttggagtcactgaaaactaagctgtgctttcgtaaagccctgtgaactgaagctagacaactcgaacttcagaagaaaataacagcaacctatttacatacataagccactttcctacctgcctccaatgtaaggatttcagagtaatgtggcctatatcaattttccaggattgttcttttgcttattgttgtttttctcccttcctccccctattttatctttaaaggatatgaagcttcacaacttctaaaaaatgagctttcctaataactcaggacctatctgcctaggaataacccattgtacccatgagaaattagaggaaatctgagatcagagactcattttcttttaacatgttttctccaaagattttaaaaaagaaaaggggggaaatgtgagagaaaaatatcctgcccccccaaggttactaaactaaagggaaaagtcaagctgggaactgcttagggcaaacttgcctcccattctattcaaagtcaccccttgctcactgagataaatgcaaatctgattgtctcctttggagaggctaattagaaactcagaagaatgcaaccatttgtctcttatctatgtatgacccggaagtcccctccaagcttccagttgtcctgcctttccagaatgaaacaatgttcatcttacctatgttgattgatgtctcatgtctccctgaaatgtataaaaccaaactgtgctctgaccaccttgggcacatgtcatcaggacctcctgagactgtgtcacgggagcaagtcctcagcactggcaaacttactaaattgactgagacctgtcttagatttttggggttcacaacattcattagcgattgggggtctaggactgaaatttaaaggcatagatgaagtctgacagatccaatctgatgttaactttgggattttctttagttaccactcagtgccccagtcctccttaaaatactttatacctccaagtctctttccttccataaaagccaattgtttctctaacactaggtctctgccttgctgttacctgccttcagaacctggggtcttcccttcatagttagggttcccaccagctaagaattcacggcctggatctctgcatattgcctatgctcagattgccttgctgccatgtcccacctatcctgtcacacttttctcacctggagtttgatggtttccttgtcactcttcctcccttgcagtgtgctctactttgcttctctgggcagacccttgcataatcctgggtctgcccctatatgcctctagtaggagttgatgctgggcttgtattttggatagtcccaatggtaaataaaccctgactgtcgttcattcatctgtcaaatatcattatgctctaccatgtattaagcattatgctaggcacttgagatataatgagagaaataaccatggaggaacacaggaactctcatacattgctgcaatttggcagtatattgtaaagttgaacaggtacatgccctactctgcagctaattaatgtctcggtatctacctataaagactcttgtttctcctcatttacttcatttgcttttctttcatttacaacatattatgtaggacatactttttttttttttttttttttttttgagatggagtctctctctgtccctcaggctggagtgcagtggagcaatctgggcttactgtaaccgctacctcctgagctcaagtaaggtggaggttgcagtgagcccagatcctcctgcctcagccttctgagtagctgggattataggcacatgccaccaagcctggctccggtacatgacttcaggtgatcctgacctcagatgacccacccacctcggcctcccaaagtgctgggattacaggcatgagtcactgtgtctggctgagcatgcaaaatttgtaatcggtagacattgtttataggcatgtttcataattataaaatgaattaaaaatcagtcacataaatatatgggctttttcaaaataacccaacatggaaaccttgatatccttccctagatctatggcagtctttgtagtctccatgacattgcacagcttgggttcagaaatgactctctagaaaaactgaaacaccacacctctgtagataatgatgtgcagctggggctcagccacttgtgttagtgaagttcctttcacaccaaagatactcaccccacttccatattatatccaatcatagtatttcaacttctgtcaaaattcccagtctccaactatggtgcagcagatcctttcaaatgtaaatacaatagcataaacttatatactgacaattctgtaacatacagaatttcattctgtatgattctatttaatagagtttcaaaatattcatatggatgaccataaaagaaagtaagattaaagatgtgctctttatgaaaaggtgtaacccacatttcaatcagggatactttataatctttaaaaaacacaccattgaccaggtgcggtgactcatgcctgtaatcccagcactgtgggaggctgaggcaggtgaatcacctgaggtcaggagttcaagaccagcctggccaacatggtgaaaccccatctccactaaaaatacaaaaatgctagccaggcatggtggcaggtgcctgtaattccagctaccagggaggctgaggcaggagaatcacttgaacctaggaggcggaggctgcagtgagccaagattgcaccactgcactccaggctgggtgacagagtgagactctgtctcaaaacaaacaatcaaacagccacaccatcggccaggcgcagtggctcatgcctgtaatcccagtactttggaggttgaggtgggcagatcccttgaggccaggagtttgagatcagcctgggcaacatggtgaaacccagtctctactgaaaatacaaaaattagccgggcatgatggtgcatgcctgtaacccagctactagggaggctgaggcacaagaatcacttgaacctgggaagtggaggttgcactgagccgaacttgcgccactgcactccagtctgggcaacagagatagacgctgtctcaaaaaaacccaaaaaaccaaaaacaaacaaacatacaaacaaaaaacaccattgtttttatttgtattttttccctatttactacttccacaggaaaattgtttgatttttgctctattttaagccaaacttcatatgcagggtaaggctgaggcaaaacaagtgagaaagtggttgtagataaatgtaaacgaatgaccatgagatgaccctttcagaacttgtgcaacacgtatgtcaccagccccattagcctgtgttaggaataacgttcaaaatcctaaggaaattgaacactcgaacaaaggattcttagcaaagcaattttacttctgcgcacaggggtgcctccttggccagttacatgagagcacacctgaacaaaggggcaggggaacctttatttctgtcgcaagtcctgccccgtacgctttttttattggccagggtcgggtcgtacaatttaaactaatctcggttggctaagcatttgattttttttagatagggtgggcacgtacaagaaagtggagaggaaggctggacgcggtggctcacgcctgtaatcccagcactttgggaggccgaggcgggcagaacacgaggtcaggagattgagaccatcctggctaacacggtgaaacctcgtctctactaaaaatacaaaaaaattagtcgggcgcctgtagtcccagctactagggaggcggaggcaggagaatgacgtgaacccaggaggcggagcttgcagcgagccaagattgcgccactgcactctagcctgggggacagagggagactccgtctaaaaaaaaaaaaaaaaaaaaaaaaaaaaataaaggaagtggagaggaaggggaagggttgtctgcaatgagctagaaagttagtctttttttttttttttaaataaggaaaggaatgcgaggtggtactgataatgcctggtactgtagcgtgcctgggcattaaaggagaaaaacggaaaaacggcgggggtactatgaattaaagaataaaagattgatcagattatttgaagagaaaccgcatcatatcccacacctgtcactacataatgaggttatgcttcatttttatatgtatataattatgaaaaaagactctgtctgtttgcttaccagatgttagcatgtatttttctacaacattgtttggagcgtttcctagagtactgcttggctttttgttcaggagccttgctgcagctgggtccttccttgcagccttcccaccctgctgactgacaggatgctacctttattgctgctgatgtttatcagactgatactctgcctctaattgcaactggcattgtctctccagctcacaggaggggaaactgttcttgtaattcttcgtaatacagttgaggcccggctaggaccttggccaggcttgggagtcatagggtttgcaaactcaaatgtcaacagaagtctggctggtaatggaagcgtgaaggctgcatagtttaagaaatgtgggcatgccatttggctttaatgttaggaaataacagccagtggccaggcgcagtggctcacgactgtaaccccagcgttttgggaggccgagatgggcggatcacgaagtcaggagatcgagatcatcctggctaacatggtgaaaccccgtctctactaaaaatacaaaaaaattagctgggcatggtggcaggcacctgtagtcccagctactcgggaggctgaggcaggagaatggcgtggacccgggaggcggagcttgcagtgagctgagatcacgccactgcactccagcctaggcgacagagcgaggctccgtctcaaaaaaaaaaaaaaaagaaaaaaaaagaaaagaaaagaaaagaaataacagccagtatgagtgaactgacgacgacatactgcatttaaagggagaagctgctattcaaagccaactgattgttgatatatggaaacagggcttagtttttccagttacgattttgcaaaagaactctgcaatttatattttttaagggaaatattcttatttttcaatactggcaactaattctttttttttttttttttaaagaaagtgctgtggccaaaccaaatatttctgtgggcctccatagaactatgaaacactaatctatgaccattgactaacaactgctaccggaagtagttacttgctactcccaggactcacagtccaactatcttttagattccctgcatagcaaccggcagacctccatgtagcatgagctgacacagacagacatacagacatacacacacacacatgcacacgcacatttacagagtgcatatgaatgaaaatcccatttatatcaggagaaaaacccacatcctccccaatattggtgttgggctccacagactactcaaagccatcactgtggtttgcccatttagtctcaaataacactttatgtggaagagaaatgttacattatagtccatatgccactgcgtcaaatccaatgcactttgcattcaatcttgccttcaggatgaggtaaagaaaagttgctactgtatgcatggcataatctcatctcctatctcctggaagcaaatggttaaacaaaaattataaacacaacttccaagaacaaaatagtaattttcagtagcaagtagcctgaattcagatttaagataaactatgtctaactctgtggaggttcagcctggctaataaatcaaatttacattaaggtcagggctctggtgggactattcccttatattcaggagtgtcttcaagaataatggaaagctacttgagtacaagagtaaaagggcccactcaatttccacatcagaatgcgggaaaaccacatgccatattctcattggaaacttctcctgcttcaaaatttaaagttcattctgcaccagataatccatttgattaaaagaaaacaacttctgagggctaacctgttaaataagcccacatccaaagtcatcttaaaggtgactatcagagcaataaaatgaaacagtaaccctgcttgaaggcaaaacaaatttgaagaacaattcagccagaggtagagtcttgaagtctaacaccagctgtaagaaatgaacactatgctggagaagaggtgagagatcaggctaccttgtttttgagtaacctagcatgtagatatctattgtgcaggaagatgtatcaggtaccttggaattacagaactaatgtctatggtgctgaatttatgctaagaaatattctgataatttaattttcccattaagaaaaagtttgctggtcaacctgaaaaatatggtctatttggccagattgacaatatttctcattataaattaacaaataagttttctggttatatactttagttacacaaatatattgtgtaattgtatgatatgattacattgagagggtctaaatattttatatacttaagaaatattaggtaagttgattttaaataggcattacagatggcaacataagtaaattaaaatatcaccttatacagtcaactcatttttaacttttctttattcatgcactggaaacatgcatttttatttttatttctcaaactattttttaagattaaatgaattcatttttctttacctgcagaaaattgccctgtcattaagaaagaggaagaagagaacattcatatttattgacagcattgtttggcctcttatatatataaaatgtcatttgttttgcacaataaccctggggaaaaaaggtattctccctgtgtaataaaaataggttgaggcatgtttagtaaaacatgccctaggtcacacagctagtaaattgtgggctaagatgactcttttattctttatgatttttttattggcacattgtagcctaaaattctaaaagaacatataatcttgtgtgctactaaaaattttaatctgctctacccaaggtttaagtagtatttgaatgagccagattgggagaggccgtgactcagtcagagtcagactgtcagacttgcagtgttgtttggaaagatgggtttctgagatgggcattaggccagggacatcaggcttcaagtaaatctaaaatctaggagattattctttgtagggtagaggagacgcaaaggacataggcttaaaataagcatattaacctgtgcagctgcattaatgagtgcggcttcaaaagaatctcttcagtaacagagaaaataatgactatattcatacatagtaggccattgacagaagacccaggaataagatcagccatatattgtatctgaaatatggctaaagtgtaattaaatatttaatattaaactaaactcatatagaactgggaaataagaccatcaaattctcagttattgttatctctgaaagtggctttgtttagttgataatttgactagggttagaattataggtccaaatatatacatatatatatatacacacacacacgtatatatatatatatatatatatatataccgtgtatatatatatatatatatatataccgtgtatatatatatatatatatatatacactttttttccaactcaatattttgctcaagtgtttaattgcaagtagtatgctgatgaaaaatctgttgttaatcttgttcttattttcctgtaaggaatctttcttttctctctagcagtgtcagaaatttcctttttatacttagtattctaagatttcaccatcttgtacctgtctttttaattttgcatggctttcactgacccattatgtagtttcatgtctttataaagttctggacaattttaggctattacctcctgaaatattttttccctacattctgtctaaatctattgaaaagagttacgagtgggtaggtaatttggtgactggtctcttggtatgacagcatctcattccttttggtgtcaccaactctctaatacactgccctatttctctgcaataagaactgtattcatctttcctttgtggagatagatattgctatttgtcttataggagggagaggagagagatactcaggggctgacctgtctgggttctccctttgtggggctccaactaatcatcctgccaatggcttttgggtacccctcctgctcctggatttcattccttccaggcatggagcatttatcttgttggtctcacctcctgggttagaacttttctgaaggaatcatgggctgtgacctctttcttttctgctcatatttttcaaagactaattattatttctgtcgttttcaccatagatatttttatttatttaaaaaataaattttccttaatttttatgaatttagtgtaagaggagggattatattaaatgctcaccattttaaaattagaagtctgtcttctatctttccttcactaatatgtgtgttttgtacttagtcatatggtcaaatacttgtacataaaattatctgaaaaagcaaatgaaaaattaactagatttccccgtcgtatttgcatgtattccttacaaacttacctcagtcttcattttttcctgctctgtccattttcatccaaaacatacacatatacatcatacagtcaagataagcatgcatatatcacaggtatctttaacacagtttgaagatgtaacccttcattaaatgatgatggagaaaaaataaaggtaaacttagagggtatagttgagagacagtattaaaacaattgacttttaaccttattggtcttgattatggaacggagatgggtgaatcgttcatttagatttttttttttttttttgagacagagtttcactcttgttgcccaggctggagtgcaatggcacaatctcagctcactgcaacctccgcctccctggttcaagtgattatcttacctcagcctcctgagtagctgggattacaggcatgcaccaccacgcccaactaatttttgtatttttagtagggacggggtttcaccatgttggccaggatggtctcaatctcttgacctcgtgatccacctgccttggcctcccaaagttctgggattacaggtgtgagtcactgcacctggcctcatttagagtttatgttatttatttatagcttgataatattttatcttttaatttttattattgtctaaatattcagatttagaggaaatattattttcttcaggcaaaataacagtcctgagaggcaaagtttttttgcttcttttttttgagatgcagtttcactcttgtcatccaggctggagtgcaacggtgcgatctcggctcactgcaacctttacctcctggattcaagcgattctcctacctaggctcccaagtagctgggactacaggcacacaccaccatgcctggctaatgtttttttttttttttttttttttagtagagatggggttcgagaccatgttggccaggctggtctcgaactcctgacctcaggtgatccacccgcctcagcctcccaaagtgctgggattacaggcatgagccgccacacccagcctgcttttaaaaatattatttttaagttattagtagaatggacttattgaaatatgtactttttaactgaaggtacttggcatagtaagtttaactatgtttaactctgttgatttgcttttacattttgtgcaatcataagtgtccttcagttcttaaatatccacagcaaatcaaatattaactctgtgcatgtttttgagtttttattaagtagtgtttatatcattgtacctattcttatagctattgcctacatccaagtaggcattttgtttagttctttttctttagtctctcgaaataatgaaaagtgaaaatttctataatttgattgactgttttaagtctttaagtatattacactttgggcaaaatgcctactactgataaagacagcaaagtttttacagatgtataattaaaaactgacaatgcagtataatggagaacacacagaaagttccctttgtagtagtaaaaatgttggtatgcatagaggtgggaacttcaatgtgctagtgtggagggagtggtgtggaagtggtatgccataagtgtggaaaggtaggtaggaaccggatctttcctggccttataggttataataaggatattagatctttttctcaagccaataaggaattttaaaataactttaaagaggggaatggcatgattagtctatagttttaaaaagtcactctgccttcattatgggaaatacattgggggcagagggtatacaaatgcacatagggaggaggatgtgcattgaaacatatacatttgtgggcacaaaataaatattttgggatattggcagattggctaactctattctcttcagacttcttttcaatattttctgaaacgtcaccatggacaaataataattaataattaataattcattaattaatcattaatacaggaggttccaagatggccgaataggaacagctccagactgcagctcccagaagatgggttatttctgcattttcaactgaggtaccaggttcatctcaatggggcttgtcagacagcgggtgcagcccagggtgcagggcggggcatcgcctcacccaggaagcgcaaggggtcagggaattccccttcctagcaaagagaagccatgacagacagtacctggaaaatcaggacactcccaccctaatactgtgcttttccaatggccttggcaaacagcacaccaggagattatatcctgcacctggcttggagggtcccttgctcactgctagcacagcagtctgagatcaaactgcaaggcggcagcaaggctgggggaggggcgtccgccattgctgaagcttgagtaggtaaacaaagcggccgggaagctcgaactgggtggagcctaccacagctcaaggaggcctgcctgcctctgtatactctacctctgcgggcagggcatagctgaacaaaaggcagcagaaacttctgcagacttaaatgtccctatctgacagttttgaagagagtagtgcttctcccagcatggagtttgagatctgagaatggacagactgcctcctcaaatgggtccccgacctccaagtagcctaactgggagactcctcccagtatgggctgactgacacctcatacagccaggtatccctctgagatgaagcttccagaggaaggatcaggcagcaacatttgccattctgcaatatttgctgttctgcagcctctgctgggatacccaggcaaacagggtctggaatggacctccagcaaattccaacagacctgcagctgagggtcctgactgttagaaggaaaactaacaaacagaaaggacatccacaccaaaaccccatctgtaggtcaccatgatcaaagaccaaaggtagataaagccacaaagatggggagaaaccagagcagaaaagctgaaaattctaaaaatcagagcacctcttctccaaaggaatgcagctcctcaccagcaatagaataaaactggatggagaatgactttgacgagttgaaagaagacggcttcagacgattggtaataacaaacttctccaagctacaggaggatgttcaaacccattgcaaagaagctaaaaaccttgaaaaaagactagacaaatggctaactagaataaacagtgtagagaagtccttaaaggacctgatggagctgaaaaccatggcacgagaagtatgtgacgcatgcacaagcttcagtagccgattcgatcaactggaagaaggggtatcagtgattgaagatcaaatgaatgaaatgcagtgagaagagaagtttagagaaaaaagagtaaaaagaaatgaacaaagcctccaagaaatatgggattatgtgaaaagaccaaatctacgtctgaatggtgtacctgaaagtgacggggagaatggaaccaagttggaaaacactctgcaggacattatccaggagaatttccccaacctagcaaggcaagccaacattcaaattcaggaaatacagagaatgtcacagagatactcctcaagaagagcaactccaagacacataattgtcagattcaccaaaatagaaatgaaggaaaaaatgttaagggcaggcagagagaaagattgggttacccacaaagggaagcccatcagactaacagcggatctctcagcagaatctctataagccagaagagagtgggggccaatattcaacattcttaaagaaaagaattttcagcctagaatttcatatccagccaaactaagcttcgtaagtggaatggcacaatctcatgcgccaaacaaatgctgacagattttgtcaccaccaggcctgccttgcaagagctcctgcaggaagcactaaacatggaaaggaacaactggtaccagtcactgcaaaaacatgccaaattgtaaagaccattgaggctaggaagaaactgcatcaactaacaagcaaaataaccagctaacatcatgacaggatccaattcacacataacaatattaaccttaaatgtaaatgggctaaatgctccaatgaaaagacacagactggcaaattggataaagagtcaagacccaacagtgtgctgtatttaggagacccgtctcacatgcagagacacacataggctcaaaataaagggatggacaaagatctaccaagcaaatagaaaacaggggttgcaaaaaagcaggggttgcaatcctagtctctgataaaactgactttaaaccaacaaagatcaaaagagacaaagaaggccattacgtattggtaaagggatcaattcaacaagaagagctaactatcctaaatatatatgcacccaatataggagcacccagattcacaaagcaagtccttagagaactacaaagagacttagactcccacacaataataaagggagactttaacactccactgtcaacattagacagatcgagacagaaagttaacaaggatatccaggaattgaactcagctctgcaccaagcagacctaatagacatctacagaattctccacctcaaatcaacagaatatacattcttctcagcaccacatcccacttattccaaaactgatcacatagttggaagtaaagcactccttagcaaatgtaaaagaacagaaattataacaaactgtctctcagaccacagttcaatcaaactagaactcaggattaacaaactcactcaaaaccgctcaactgcacggaaactgaacaacctgctcctgaatgactactgggtacataacaaaatgaaggcagaaataaagatgttctttgaaaccagtgagaacaaagacacaacataccagaatctctgggacacatttaaagcagtgtgtagagggaaatttatagcactaaatgcccataagagaaagcaggaaagatccaaaattgacaccctaacatcacagttaaaagaactagaaaagcaagagcaaacatattcaaaagttagcagaaggcaagaaataactaagatcagagcagaactgaaggagctagagacacaaaaaaacccttcaaaaaatcaatgaatccaggagctggttttttgagaagatcaacaaaattgatagactgctagtaagattaataaagaagaaaggggagaagaatcaaatagatgcaataaaaaatgagaaagaggatatcaccaccaatcccacagaaatacaaactaccatcagagaatactataaacacctctatgcaaataaactagaaaatctggaagaaatgtataagttcctggacacatacgccctcccaagactaaaccagtaacaagttgaatccctgaatacaccaataaaaggctctgaaattgaggcaataattaatagcttaccaaccaagaaaaatccaggaccacatggattcacagccaaattctaccagaggtacaaagaggagatggtactattccttctgaaactttcccaatcaatagaaaaagagggaatcctccctaattcattttatgaggccaacatcatcctgataccaaagcctggcagagacacaacaaaaaaagagaattttagaccaatatccctgatgaacatcgatgcaaaaatcctcaataaaatactggcaaacccaatccagcagcacatcaaaaagcttatccaccatgatcaagtgggcttcatccctgggatgcaaggctggttcaacataagcaaatcaataaatgtaatccatcatattaacagaaccaaagacaacaaccacatgattatctcaatagatgcagaaaaggcctttgacaaaattcaacagcccttcatgctaaaaactctcaataaactaggtattgatgacaagtatctcaaaataataagagctatttatgacaaatccacagccactatcatactgaatgggcaaaaactggaagcattccctttgaaaatcagcacaagacagggatgcctccctcaccactcctattaaacatatcattggaagttctggccagggcaatcaggcaagagaaagaaataaagagtattcaattagacaaagaggaagtcaaattgtccctgtttgcagatgacatgatcatatatttagaaaaccccatcatctcagcccaaaatctctttaagcgataagcaacttcagcaaattctcgggttacaaattcaatgtgcaaaaatcacaaggattcctatacaccaataatagacaaacagagaggcaagtcatgagtgaactcccattcacaattgcttcaaagacaataaaataccaaggaatccaacttacaagggatgtgaaggacctcttcaaggagaactacaaaccactgttcaacgaaataaaagaggacacaaacaaatggaagaaaattccatgctcatggataggaagaatcaatattttgaaaatggccatactgcccaaggtaatttatagattcaatgccatccccatcaagctaccaatgactttcttcacagaattggaaaaacctactttaaagttcatgtggaaccaaaaaagagcccacattgccaagtcagtcctaagccaaaagaacaaagctggaggcatcatactacctgacttcaaactatactacaaggctacagtaaccaaaacagcatggtactggtaccaaaacagagatatagaccaatggaacagaatagagcccccggaaataataccacacatctagaaccatctgatctttgacaaacctgacaaaaacaagaaatggggaaaggattccctatttaataaatggtgctgggaaaactggctagccatatgtagaaagctgaaactggatcccttccttatactttatacaaaaattaattcaagatggattaaagacttaaatgttagacctaaaaccataaaaaccctagaagaaaacctaggcaataccattcagggcataggcatgggcaatgacttcatgattaaagcaccaaaagcaagggcaacaaaagccaaaattgacaaatgggatctaattaaactaaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaaacaaacaactccatcaaaaaatgggcaaaggatatgaacagacaattctcaaaagaagacatttatgcagccaacagacacatgaaaaagtgctcatcgtcactggccatcagagaaatggaaatcaaaaccacaatgagataccatctcacaccagttagaacagcgatcattaaaaagtcaagaaacaacaggtgctggagaggatgtggagaaataggaatgcttttacactattggtgggagtgtaaactagttcagtcattgtggaagacagtgtggtgattcctcagggatctagaactagaaataccatttgatccagccatcccattactgggcatatacgtaaaggaatataaatcatgctgctataaggacacatgcacaagtttgtttattatggcactattcacaatagcaaagacttggaaccaacccaaatgtccatcaatgatagactggattaagaaaatgtggcacatatacaccatggaatactatgcagccataaataaggatgagttcatgtcctttgtaggtacatggatgaagctggaaaccatcattctgagcaaactatcgcaaggagagaaaaccaaacaccgcatgttctcactcataggtgggaattgaacaatgagaacagctggacacagggcggggagcatcacacattggggcctgtcatggggttggggaagcagggagggatagcattaggagagatacctaatgtaaacgatgaattaacaggtgcagcacaccaacatggcacttgtatacatatgtaacaacctgcccgttgtgcaaatgtaccctagaagttaaagtataaaaaaaaaaaaaagaacaagaactccaataacaggccttgaaaaactaagcgtgaaatccaggttgtggaacgtttgaccccaggaagaatgtatttcatctgtgtgtagttcatctgtattcttgtggtaatcaagcagacaccagctagaccactagttggcccactgctcaagacagtcgtcaagaccagacatactaccgcacacgtagtcaactcctgtgcttcccataaaaaccgtctagctagcctgagaaacttgagatgatctttgtgacatgagtccaccatctcctctggttgtcaactcctgaataaacccatttttctccctcaaaaaacattaataattattaataataaattaacaataaatcattaacaataattaataattaataataattaataataaaaattaataaaaataaaataaaataaaagtattaaaaactctaataaaatataatacaatataatatataatacaatacaacataatatgtgttatggctaaggaaatttcagattaggaaggacacctaatttagactaaaagagaacagcttcctagagaaggtgaaagatgagttaagtgctgatagctggatagttcagtcagaccaagaaagaatggcttttctgaatcaaagaagaacatttatgtggatatcctgataaaacggaaaacagatcagagtacaaagtataccattaccagggatgtggctgaagagataggccgacaagatattagatattatgctaaaaatccaggatttatcctgaaatggtgaatggtaattgaaagatttttagcaagacagtgacatgatgaaactggtatttcaaaatgaacatgctagcaagaggtgggataatgtactggatgagaataagacgggaagcagagaggcccattaggaatttgattcatttattcactaatggtgataccaaatgcttagtatgtaacaactattgagccaggtgttagggacacagtggtcaacaaaaaagagggccactgctttccttcaaaggtttaaaatctagcacatcaataaaataatacagggaggtaatccagcgcttgaccattctctccctttaaaaattatgtgtgttactttattataatttaaaaatacagatgaataagaagaatgtgaacaaaatcagacatccactcaacctctatggaatgttaacattttattgtgtgtacatacttctagatgtttaaaaatatagtatgtgtatatattgtatatcatacaattatatgaataaatcagactgttctcaattggtttatgatctagtttcctcttaacaacacatggtgatctttccataaccataaatctatttatccatattattttttatgaggggatgatgttctactgcattttcggacattttaggtaggactattcaaaacaatgttagaatgaatattcttataggcaagttttaaatttcatttcattagattaaattcttagaagtggaataaaagaaaatgcacattttaaaggcctttgataatgccccaaaccctcctttataatcttttcttctggcttccataccatactttgttaggttttttttttttttttaactacatcagcaactcatacacagtcttcttcattagttcattgctgcacattgaaatcatctggggatttttaaaaattactgatgcctggctcccacccttagacataccaatttcattggtatgtggtacaatctgggaattggaatttttagaagtgcctcaagtgattcttacttgcagcaaaagatagaaaccactgtattcttttattttccctgtttactacagaaatttaagttccatcctagatctgcatcttaccttttttcacatgctcttcatatgtaatcataatttcacctcttccactctaaactctatgaatataattaaaaactcgtatcttgcacttttcctgaggtccagttccactttgttcattgcctataggaaagtgtgcactaatgctaaatatagaattagctctcaaacttggtgtatctcaaactgaattaagaggtctcccttactcttgataaacagaaaactaaacacatgtttaaaaaaacagcaacacctgtggggaaagatattttctacctttcagttggttgcaaagctcttgtcttgattctttctctaaaacatattttaaatcagtttcccctaccctttctattaccattaccacaacctctaccctcagagtagtaccactgtgacaatacttatctgaatatctgtcttgggagcactggcctgtcagagtagtttgcctgcaatctcacttgcatgaagatagcacctagtgaataccagtagatatgacattagggactgaaatcaaggtggaattaaaaatttcaacacatgtaagtaagagtgtgtgtgtgtgggaggaagtgggataatgtaggagaagggacagtgatcatttccaactacttgaagatggccactcttgggccaggaactcagcccagggttggagaatgttgagatacatcgggctcatcccgattgatttcaggctgcaaaggtcactttgagaattaattgacccaataatggaggaacaactataacgttccaggagaaagaaggctaaaaagcaaaactattttatttgtgttataaatatctgaatttttaaaaaatttgaactccttacccaggcaagtctgccataatttcaaccaaggaatactgacaaatctagaaattgagagatttataagctactgaatctaaaatatggaagcagctaagctgacatgactggggaaagtgaggatcctttaatctctgactgtgagggtgactgtccttgacatgctgtgaagagtagctataaaccatcacttcttgtttctcagatctcaaactattgatccactcagctaaaataaaagctccattgagcagaggccttgattgtacaattaattattctccagcagctctgagagtgtgagatatatggtagccatacaaaaaatattgagttaataatttctcatactggggccaaaacccctgtgaccatagtagcaatgtagtagggtgttcaagtgtgttacttctttagaattttagaaatgtaatttaagaattttttttttttttttttttgagactgaatctcactttgtttcccaggctggagtgcggtggctcgattctggctcactgcaacctccgtctcctgggttcaagtgatttgcctgcctcagcctcccgagtagttgggattacaggcgtgcgccaccatgcccagctaattttgtatatttagtagagatggggtttcacatgttagccaggctgatctctaactgctgacctctggtgatctgcccgcctcagtctcccaaagtgctgggattaacaggcgtgagccaccactcctggcctaagatcattttaataagatttaagagacactaatttctgtctttcaagagaggtactaatttccatctaagcaggcccaccagaaagtagatatggaaaaacaggacaagcatataatatttgtaaagcaaagcattttatttctagaggaagatttgaaatccatggaagttaggagataacacagttgttttagttatttgtcacactttaaagtcattgtagcagttaggaaatagtgagatcttggcaaacaaaatgtggacatctaggagaagccaaagagttggcaacactttttaagcatctctggcagctcctgtctagttggactaaaggaataccatatcctattataaatcacatttccctggaactcagcttaaagggcaaactttagaaggaaaacctccatcatcctcattcaatacttcagctactgtttcttatccgcatctaaacaaaggccattaaatagagtttcagggaaaggcagagctgccaggaatgatgcagagatggcctttttctttagtaaaccagaagcttaaatgggcatgactccataagattttttgttttagtaattagcaaatagagtttcaaattcaaattgacttgaagcaagcagaagttttaaattaattaaattttccaggaaagggaagcctagccctaggaacagagattactcaacttgtaatgcattcctcaggcctaagtatccacacctataaagaatgacttggacttgcaaaggtaatagagctacttaagaagaatctctccaacatccctctgagaagcagcccagaaagatacaaggcaagggaaatctttccagggagaagaactcaaggtgctgaatggcttttaaaggacatttctgagccgggtgtgttggctcatgcctgtaatcctagcactttgagaggtcaaagcgggtggatagcttgagtccagtggtttgagaccagactggtgagcatggggaaatcccacctctacaaaaaatacaaaaattagctgggtgtagtggcacacacctgtagtcctagctacttgggggctgaggctggaggatcgcttgattctaggaggttgagggtgcagtgacctgaggttgtgccactgcacttcagccttggcagtagagtgagaccttgtctcaacaaaacaaaacaaaacaaaacaaacaaaacaaaacaaaacaaaacagcaaagacactttctctatttccaagggagcaagtcaagaacattttatactgcctgctcctaacaagtgattattctcaagcccctttctttcccctaaatgagataattttattaaggtaattctgtctgtggtgcacctttatttgcccctctgaatccttctccacgctccaccttcctctacctgcaatgctatcctgggaggctgacctgcatgaaaaaccttaaaggattcttacctcctctggcttccagttgggttcagccaatggcacagcagtagataagaaggaggtggggcgggcgcggtggctcaagcctgtaatcccagcactttgggaggccaaggcgggcggatcacgaggtcaggagatcgagaccatcctggctaacatggtgaaaccccgtctctactaaaaatacaaaaaaaaaattagccgggcgtggtggcgggcgcctgtagtcccagctactagggaggctgaggcactagaatggagtgaacccgggaggcagagcttgcagtgagccgagatcgcgccactgcactccagcctgggcgacagagcgagactctatctccaaaaaaaaaaaaaaaaaaaaaaaaagaaggaggtgggaggctaggagctaggataagggtacttatcttaagcctccgttcctgtgtccctcagctgaaggtcactgctcatttcaggccaaatggcttcatgggactctccctcctttagtaaccgctggccgaggggcaatagctcagctactacaaaaccccgagctcttgaattataaatcagaattaccctacgtccacacttaatttccttcttgaaatctactctctacatagacaagtgaattttcccctccctgaccaaatcaggcctccaaatataagcttttgtagcttgcttaaattcttgattaatttttactattaaatgattagtttgaattctcccttcctctcacagaatgtaagtttcacgagagcagaaagtgcattagtgttgttctcagctgtttgctcaaggtttaaataaaaacttaaacatagaaacaaaaatttttctttttagttgtgctttctattttttcttgggaccctgatagacagaacagtgaaattcatcatctaactgaagattgcagtattttggaacttggcattaaaagcctgactcaattacactgaaggagattgtacatctcacagaaagcttggacttgagcactgacctccagacactacctgagaaggtctagtagacatgattttccattggagaggtggtggtgtttttgatggcatgtagattgtgactggcaggggcatttttggaatgtaagcatgtctttgagtatgtgctaggtaaaattgaagagtagattgtagtgagcctccactgtggttctgctttatgccaataatttttcttttaattttctattcataaaataatctgcattaggacttttgccaattcagcagaattatgtcattaatacaaaggattataatagaacataaattggctggcccatgcatgaaatccaaaataatatgagtattcacaattttgacaaagcattcaccttaagaagaggcaaacaagcagggaactaatacagatacagttaggtttggtagaacactgatacttgtgatatttatgacataatcatggttctttttgtcataatatggtattttatatagctatttacttaagtgactatatgcatatgaactactaacatttttcacattttctctgcccatatttgggctgctcaataacagatagaaatgttatagttaaaaagaaaattattggccaggtgcggtggctcatgcctgtaatcccagcactttgggaggccgaggcgggcggatcacgaggtcaggagattgagaccatcctggctaacactgtgaagccccgtcttactaaaaatccaaaaaattagccaggcgtggaaggacatgcctgtaatcccagctacttgggaagctgaggcaggagaatcgcttgaacctgggaggcggaggttgcagtgagccaagatcgcaccactgcactccagcctggatgacagagtgagactccgtctcaaattaaaaaaaaaaagaaaaaagaaaattattatctggctgggtgtagtggctcaacctgtaatcccagaactttgggggctgaaggggtggatcacctgaggtcgggagtttgagacaagcctgaccaacatggtgaaaccccgtctctactaaaaatacaaaaaaattactgggcgtggtggcaggtgcctgtaatcccatctattcgggcagctgaggcaggagaatcacttgaacctgggaggcaggggttaccataagctgagattgcgccattgcactccagcctgggtgacaagagcgaaactccatctcaacaacaacaaaaaaaaaaaaaaaaagaaagaagaaaaaaagaaaattgttacctattctccttagataaccctaatcttaatctagtaatactgtatcctttttgagaagatttcagctgtatcctttttgagaagattcagctaaaggttaattcagctaaaggttaacttcagctaaaggttaattggttaacgtgacatattacgcttaaaaatccctaaatgagtcgttttaaaaacctgtctttccctctaatagccagagtttctttgtgctattgtgttactttctgattcatccgagtgatgcttgagaatgccaggaaaacaataaaaacatttcttgccactgagccctacctttgcctggaactcagtgaacatcctccatgaggtggcaaaattgttctggtattagtttgtagtaaaatttcctgaattaggagtggaaaggaagacaatattatgtaaaactttccgtgggttcacaaaaatgaagtgttatcttgtgttcagatcccagacttagagaaaatgattgtgttttctttttcttttcttttttttttttttgagacagagttttgttcttgttgcccaggctggagtgcaatggcgcaatctcggctcaccgcaacttccgcctcccaggtttaagcgattctcctgcctcagccccctgagtagctgggattacaggtgtgagccaccatgcccggttaattttgtatttttagtagagacggggtttctctacgttggtcaggctggtctcgaactcccaacctcgggtgatccgcccgcctcggcctcccaaagtgctgggattacaggcataagccaccatgccctgccaataaaatgattttgaacatatagttctatattatttatagtgaacatttaatggaggggaagttctgccttcaggaagactatgaatattgggactgtgtccttagtagacttggcactaaaaaaaatcactcatttgacatcacaagattgcacaataaatattggagatgttggaaaggtacaggtacacaatggaatactacacattcgaaatgaagctgtagaattgaatttattgacaaagatgtttataatatatcatcattaagtgcacaaaaagggtaaactatatgctgaaggatagtttgggcagcaagcaaaagaacatctaattcaaaatgaattaaataaatatatttatttttataattatcataattacatttattaatctaattgttctagtgcagaggtaaaataggcttcagggtagactgattcagtgacccaacaatattattaaaaaacaatgttctttctgtctctctgctctgtaatccaaaatatctgctttatctcacagctagttcccccaaataattgtaagatagattccaggtgcaattggatattactacttgctttctcattcatatgctgaagaaagagagaatggcttgttattgctttctgcaaagaccaaagaggaaatttttgaagtctgtagccactatctcttcatttatcattggctagaactgctgatttctaaactgatagctggcggaaagaatgtgattatctttagaccagtcagactcacacattgagttaaaggcaatttctaaaatcagagtactgccatttcatggatagtagaatggaatgcatttggggatttggacacagttaaaaaaatctctatctaatctctctctatggatattctagaaaattaatattgtcatatgatagtatctggacaatgacttacatttctttttaattttcttcctttcactcacatgtatataatattcttctgtaaataagcatacattgttttttgtctctttaacattttatatggaaaatttcaaataaatccaaaaataaagatagtaataaaatgaaacctcaagtatccatcacccagattcaacaattatcaacttctggaaaaccttgttttatgcactgtttgtaataagaaaaaaaaaagttgattttagttaaaaaagaagttaagatctgcttaacattttctcttgtccatagaatataccttaaagcaaatcagtaaagtttagctaaggatagcccaatatttttcctgtcaattgcccaagatctctcttaaattataccccaagtatttttttgaaaatttggtttttctcagtttcttatcctacatatgcatctcaaaaatttggaccgcagtaccccaacatcaggagaaaagcacaaaactctaggagcttgtgtatatgaaacaaagtggctcactaaaagcatagttattttgaaatctcatttttagttttaaagtctgtatttttttttttttactctatctaccaatgtttaatagaaataaaatatttcaaattactcaccattgaataaacttgacactgttggaagatggtccatgttggtcttttggcttcttgtcctctgaggcaccctgacaaatacccctgtgaacacaaggtccccaatttaagagtcatagattatagttttcttcccttttaagactccccttttgatcgttgaccatatttccttgacttttaaacttcattctctttgaggactttgctttgaattcagtcctcttgttttttccattttagacctcctcagctcgtatgccctatcttaggattaatactcactttccagtcctggccaggcctggcccagtactctgcaagaggatcttggacctgtaagtcacaaatatcaaggtactcattcatttactaaatctttattgagtatcaaccatgtttctggcacttagctagtccttggggatactgtggttaaaaaggataaaatctcagtgtttaagaagactaaagacatcaggaacacaaaaaatatttaggcaattataaaatgggcaaataagtgctacattggatgaagtactgcatcctataaagcacaaagcagtatcctaagcagatgagggaagtcttccaggaatgagatgcagtataacaataggaaggaaaagtaagtggtggtaattttctatatttgaatgaaaacttactcttgctcaaccacgaaggatgttttcttagaaataaagggattgtcaaaagcagcattcagtatgggagcttacagtgatgtatctagaggggacaagcatgaagagtttgattactcgggagtgcagtttagaaaataactatgtttccttcacagaaaggaagtgttctgccaggcggagtcattgcttccttttctctcttcccttagtcctttgttttcttttttcttttgttttcttttctattttttctattttttttttttttttgagatggagtctcactctgtaactcaggctggagtgcaatggtgcaatctctgctcactgcaacctctgcctcccaggctattctcctgcctcagcctcctaagtagctgagattacaggcacatgccaccacaccaagctaatttttgtattattaatagagacaggggttttaccatgttggccaggctggtctcgaactcctgacctcaggtgattcgcctgcctgggcctcccaaagtgctgagattacaggtgtgagccaccacgcctgggccagccctttgctgtcatatcacatgtggaacatccctacctgcctctcctatgccttcctacctgaagaaataaattaatcattttcccttctaatctacaaactgtgtattatactgaaacacaatgatactttaaaaaatttaagaattaaattgattcaaattttattttatttttagattcaactgattattttgattacttaatcattaaaaaatgatactgttcagtattcagaaagtttgggttcatttttttctttcttgtttctcaataaaagaaatgggtagtggtagtgatgttggcatttgttctgaaagataaatgtgacatgatactcatttcctgcctggcgcggtggctcacgcctataattgcagcactttgggaggctgaggcaggtggatcgcttgagcccaggaattcgagatcagcctgggcaacatagcaagaccgcatccctaaaaaaggagtacaaaaaaaaattagccagtctcataacttggcctgaaaataaataaataaataaataaatagactcatttcccattgagtaatccagaaagagacacaccctgaatggtattgcctaggttttcttctagggtttttatggttttaggtctaacatttaagtctttaatccatcttgaattaatttttgtataaagtataaggaagggatccagtttcagctttctacatttggctagccagttttcccagcaccatttattaaatagggaatcctttccccatttcttgtttttgtcaggtttgtcaaagatcagatggttgtagatgtgtggtattatttctgagggctctgctctgttccactggttataggaattggcaaggacttcatgactaaaacaccaaaagcaatggcaacaaaagccaaaattgacaaatgggatctaattaaactgaagggcttctgcacagcaaaagaaactaccatcagagtgaacaggcaacctacagaatgggaggaaatttttgcaatctacccatctgacaaagggctaatatccagaatctacaaagaacttaaacaaatttacaagaaaaaaatcaaacaactccatcaaaaaatgggcaaaggatatgaacagacaattctcaaaagaacacatttatgcagccaacagacacatgaaaaagtgctcatcatcactggccatcagagaaatgcaaatcaaaaccacaatgcgataccatctcacaccagttagaatggcaatcattaaaaagtcaggaaacaacaggtgctggagaggatgtggagaaataggaatgcttttacactattggtgggagtgtaaactagttcagtcattgtggaagacagtgtggtgattcctcagggatctagaactagaaataccatttgacccagccatcccattactgggcatatacgtaaaggagtataaatcatgctgctataaggacacatgcacatgtatgtttattgtggcactattcacaatagcaaagacttggaaccaacccaaatgtccatcagtgatagactggattaagaaaatgtggcacatatacaccatggaatactatgcagccataaaaaaggatgagtttatgtcctttgtagggacatggatgaagctggaaaccatcattctgagcaaactatcacaaggacagaaaaccaaacaccgcatgttctcactcataggtgggaattgagtaatgagaacacatggacccagggtggggaacatcacacaccagggcctgtcatggggtagagggagggaggagggatagcattaggagatctacctaatgtaaatgacgagttaatgggtgcagcacaccaacatggcacgtgtacacatatgtaacaaacctgcatgttgtgtgcatgtaccctagtacttaaagtataataaaaaaataaaaataaataaaaaaaagaaagagacacacccaaccattattgaagtcctctaaggtggggatagaggacacacagttcatcagggctgaggaatagagaatgggaaaacagatgaagaaaggcctgtgctgaccttttccatgccctcccatggatgtgtttttcctgcacgtcaagttatttaagcaaaggattgtttttgtctggatttttttcttttccaacttcagccatttcttttgttctttttaggcatgaaacattaaataaagttattcttaatatgggatattctcccctaagtctttttagatgataaggaaacagcatgtccattccaatagcctgttcaagagttctacttttaataatttgtgtctcatacttccagatagtccacacatagggcaggtcttattatttcttgtgtatttcattataaccttattaggcccaaacaaaataagagtcacgaataggcaggaaaacatatgactgtagtaagctaggtgttgaacaggaaactgtggcttccagagattaaaatagttttgtttgtgatcttagaggaaacccaaaaggtgttcacttaggtctggttttaaacaggcagaacaacttattttaaagtaatatttctggtaattctgcagctactttgtagtgcctctgctgttctaggcattgtgctagatggtatgaggaattaaagatgaataagaacaaagtttccttcttaggagggaatacaatctaagttagcttttctctttatttatttatttatttttctgagatggagtctcactctttcgcccaggccggactgcagtggcactatctcagctcactgcaagctccgcctcctgggttcatgccattctcctgcctcagcctccccagtagctgggactacaggtgcccgccactgcacccggctaatttttttgtatttttagtagagacggggtttcaccgtgttagccaggatggtctcgatctgctgacgtcgtgatccacccacctcggcctcccaaagcgctgggattacaggtgtgagccaccgcgcccagcctgcttttctttattgtaaccaaaatcatttgatgacttccaaacagggcaacatatgtgtcaaatatggtcatatttaaataactatgccaaggttctgcagttcaattaacttcatttaatttggacacttctagtattagaaaaatatctttttttgctatcatccattaaatcatcaatatttttaaagattcacttccatctctctttttaagaatgaggtgttacataaaactataggtaaatgaatttgaaaaagaaagcaagtaaggctgagtgcagtggcttaatgctgtaatcttagctctttgggaggccgaggcaggtggatcacttgaggtcaggagttcgagaccagcctggccaacatggtgaaaatccaactctactaaaaatacaaaaaattgggtgtgttggcatgcaccagtaatcccaattacttgggaggctgaggcaggagaattgcttgaactcaggaggtggaggttacagtaagctgagatcgtgccactgtactgcgccactgcactccagcctgggtgacagagcaagactctgcacccccacccccccaaaaaaagcaaacaagcaagtgcaagtaagactttgtatctctgattagatgttgaacagtgaatgtctcttcccagacaatttagataatttacatacattctttctctggttagccttacagattaaaaaatggtggctttttaagttttaagttgagtgacttatcaaaaatactttaagacttgaagaccaccagtctagaagttagagatgaaatattagaatatggcagtaaacagtccagcctatgaactagaactagattgactgggttcaaatctcagcttagccacctactagtatgagacttgggttaagttaaaaaagcccttgtatctcagttctcttatttttaaaatgctgataacaataatgtttgtaagatgttgtgggcattaaatcaataaatatatgtgaagtgcttgaaaaaaggtatggcataggcaaacactccatagagtgtcacctattatcatttttatgtgagtgtgggacctgctatccaatgacatcagtagtctcccactgtgacataaaaggattgcatacaaagaaatgcttaataaataattcattcgttcaaacaagtatttttgagagcctgaattctagattctggggatagagccaaggaggacaagctgaagttctcagttttaagggactttcatctgaatgaagtaaactgacaataaacaagaggaacaaatatacataaacatattaagcattactacctactttgaagaaaaagaaagcaggctaaagggatagagactaataaggaataataatgggcaagctgttatagatggggagatttacactcttttgaggagatgatatttgagcagagatatgaatgaaatgagagtgaatgctgggaaaatcaacaggaaatgaattctagaaagtgggaacagcagaataaaggccaggaggcagaactgaattcaggggttcaagagtaaacagaaggcccatcgtggcgtgaagtaagatctagtattcgaagatgaggtagaagtagtcaaataattttggatgaataatagatacatttaatgactcaatcaaaatgatgagacatcatgctgaaaggaagcttaagatacatttgtaaataagattataagatgttgagtgggactttttttgttgcccataattgaaaataagaagagctaagtaaccccctttctatgagaagctcttaatagatgccaaatattgaggccagacactgtccccacctactaaagggtatgttacgaggcgaaaaaaattctctcctaccagcaactagcacctagctctggatacgcataaagagaaaactggagagagaacagtgcaagtcagcagacagtgctcacagggaaaggttactcctcttctcaaggggaacagaaggattattatttttttcttgctgaagccaattaatgggagtccatcagagaatgtttagagattgtgtgcgagtttgtgggaaggaagactggcaattcatttctcagctggctggatggtaatttactaaacacaccagtccctctggagctactatggcggagcgggggcgaatgtctccgcggagttgtgtatttgctacctgaagtttaggactcacccctgaatccaaaacagctgctagtcttaacatttctgaaggagaggaaattgctggagtagcttatggtaacagagttagaaggaactgtggttcagagtttgttcttgagaggggttaaattccctcctttatccccatcctggtcttttgtggcccttggagcatttagaagatggtctcagaggttactatggctcaatgcaaaacagcatggtggtaaggaagggagcagaatagctggtagtgaggagacactccagctggggaagcagttaggggcatggtctgctgtcagggtccaggcttttctctgagggattcctcagtgagtgagggggcaaagcaaagacgaagagtgtctatagaaaaccaagcacaccaccagcacagatttctcaacaccaccatctgttagcaatagacaaaactggattgaaccagagaaaaacctaggacactttctcacgcagacatgtaactgattatgtaagatctctaccacctttgtcttctctctctgaccccaaaactagaggagttcagcagcggggagtgaggatggttgtctcagagtcagatctccttccaacttctctactccaagcagtcagcctcacagtttgtgttgagggcaaagaaaggtaatcatatttatgttagtttcacaatccaagttttaaactggacaaaaataaacttcaaataactgaaactggtagaaagttagaagatttgcactttgggaggccgaggagggctgatcacgaggtcaggagatcaagaccatactggctaacacggtgaaaccccgtctctactaaaaatacaaaaaattagccgggcgtggtggcgggcgcctgtagttccagctactcgggaggctgaggcaggagaatggcgtgaacccaggaggcggagcttgcagtgagcagagatcaagccattgcactccagcctgggcgacagagcgagactccatctcaaaaaaaaaaaaaaaggacagttagaagatttgctaggatattcattaaaggacacgagaataagacttgacaatcatgattggaagccttgattagaataaaaaatataactcttttgtatctatgctcttgttgagacacattacatgagtaaccaaacaatgaaacataacactataaaccacagcacatctatggagaaatcaaaatgcactaatcgaaaattataatttcgtgggacattttatttaaatgtaaaatttcatctggcttctcagttttgataaagtagagagtctgtcaattgcttctttcttataataaagtgagtcaatcttccttccatcagcaacatataatacaaattcttcaggcccttgtcaggaatataaactcatactttctcctattccgtttctaaaaaggtcttctaaggaagtaatatttaagaaagttcatctaagaaacattgtaccctttgtctaagtactttgaattctgcctttgaatcaagctagaccactggaagtatatgcacctgaccacaaaaatatatctcctttaaaaatctgtcaccaactttaacttcaaaattttattctcaggcttctttgaattatcataagaaagtttataaaattctcttctatttgttggtaaaaatattgctgatattattcaacgcgttgctcagtgtcatctccatatgagaaatttctccatcaacttagtggcaggaaaaattctctcttgatttgtttctttcttttaaataatgagaattgtgaaactccctaagtttcccttgttattcttgctatcggcaagttcaaagccaaatttgcagctctgtcagagcaagtctcttatacaatatgtacaatgtattccacttcggttttttcttgaatttgaaccttattttatcagtatattttatattttaggggcgttgtctatttgtaaagaaatggagtataggtaaataaatttggttcatgtgctaggaaaagttggttcagatgactgaaagttgatctcctaacatgaaattgattaatctttgaggtgtttttcaaagactacttgcaaaaaaaaagaaaaaaaaaaagagacttaaaatggcccccaaaatgttatcttcattcattagtttaatatcattaaccaggctaaactgtatattccaataaattgaacaataataggattattttaacattattactgtcagttaattctaaaaaccttatctttggtttttattatatgtaccattatatattgaaaagcttagcagatcctcacatcaatgtccagaaaaattatctccagcattatgaagacacttatatcagttgtagaacatcttatagaagaatagggaagagaggtaatattttgggtaagaatgtagcacaagcaaaaggagagtcagtgacagagtagtgacagcttgtctctaaatgctaattaattatattgatcctctttgttttctcagcttaaacaaaataaagtgcatgggtaccttcaaaacaacacatgatagaagggaatggattcacaaatgacaatagctgtgtttacctggacacctagttaattcactagtttaacaatattggccagtctgtaatgtacatcccaataaactgaccaataaaaggattgccttagcattatggaaatatagctaaagtataagtttaagggcttccataaattaatcagattattattatacataggcatttatgtattatcaggtataaaagacatttgttcaagctaggagatattcaaataatgataaaaatcatctatgactagccacctgggaactatacttttctagtttaaagccataagatgcctcattgctttgacattgctaagtataaaaaggactgtagaataatttgttggtgataaaaatgtctgtggtcacattgctattttacttattatgcaatgtaagatatctactgtggatttctaacagactcaagtccacaaatatatttctcctgactgttcctgacattgcacagaatggcacagggaacacagaccaacacacaaaaagaagagtaactctttgaaaacattttcttcacactgtagtttaggacaaaagtattgcagaataaaatttatggttttagaaaaaacagcaacaaaaatttgaatgaaagacaaacttttgctttttcgaacttttggaagacaaaattatgactctaatgtttcattccttcttctttccttgccattcaaatttctactaaagtgtaagatatatcataaaatttgataatatacactgcaatgcccattgagcagactgaacaaaggccattaatatagcaaggaagacatatttttaatatctttagtctgacattcacttgtcctttatttacatatgcgtaatctcttaattttctacaaattgtagcttatactcacagagttttaaaaaaattcatgatagccctctcattttctgtatctacaattctaggttatatattaccctaagtatacaggtccataggcctatataaagaatttatttgaatttgaaatcttgattttgtgaaagaaacaaatgtcttgagattttgttaaaataagtctggcaagtcttggcccaaagttacactgagagggaatctgttttcctttgaaaacaaaagtattatcaatattttcataaaatgtgagtataaaatagaacatagtattattaaaccatattaacatttcattggcagagatttcactttgttaaaggctgtataagaacagcttaatctcataacccagaagtttttactgttattattgcctctttatttttggctaaagtgtaatttttaaatgagtatacagaaacctaatactatatattgaatgactttaagtaaataaatatccatgctattcatcaggataagtgacctagtgaccagaataaaaaggatatatgttggtagcccctagcacagtatgcctcagcacagaggtttcttgggttactgctagtgaatgattccaattcttggccgtctgatcccacacattacataaattccaactcctgcatctgtttaggtgagctgttggctaaatggatatgtaatgaaattaaacaatatttttaaggtgctttttaggatgggttataccccctctttttctcctcctttccttgcaacctgccctctactcattctttttatgcatatttttgagagcctgaatatgctaggaagagggtttcagtctgttaagaattcacaaccttgtggagttgagatacaattaataaaatttctagtataatgaggtaagtattatgataccatgaaagcacagaggagaaacacctactctgttttgtaaggattagggaaagcaatttagagattatacctaacacaaacacacagatatttgcatagtatgtgagcacacgtttaaaaaaatgtaattttcaccctagaaataagacagtagtgattcagcgtgagttgatatgcctgtctccactataatgaaagaaatataacgtcttaagtatgggttgacatttgcaaactaactgatttttctagaagaatgatgccacataatttaaaaatattaatgcttttctaatctctagtgtattttcaatggctaacatagttaaaaccaaagtgaaatttttattatgtacataatcgaatgcaaattgtgtcaggctagtttaaaaaatatgaatgtcagtcctggcttggcaatttaataactatttggtttttgaccaagtcatttaacttaattaaacctcagtttcttctctgtaaacaagagaaggtcaagcaagatagttttaaaatttctttccaaatttatacgtctgacttttctaaaaaatctggtttacactaatacttaaaagaaattatcttaaaacaataaattataaatttattttttgctcttgctccctgtaaaatttgtccttgtcctgctagtcacatatagtccccactacaccagccaagacttgtcagactggttctgttgagatcatcagtgacttatttcctcacttcaattcagcccacaaagtcattgatagagctggattcacacacttggatgtagacctcgaccttcacaggactcttcattgctggttggcaatgatgtatcggtgagttagttccctttttctttctagaagtcttaaggtaacttttagtttaaaacagtatgagccacaccaaggaatgtgtagatctacagtttattatttttttaaatatagaaacatatttttgagattttacataaaattatgtcaagaaaaagatttctattctttctgtattagtgtttcctgtcctcttttgttgtatcccatgtgtttttctgtttacttttagaaggtttctacacaatgtaaaggtacatggtgtttgacagctgtcttttagttagtttggccatatgtttcaagaaagatataacatatttttagcttgggctttgtttgtcttattgagaaacacttttattttagaaggtgtacatgaaaaaaagtctgaaataatgcagaaaaaaatgtttatttctgtaagtagttaaaaatttaaaaactctagatgttttgaaagaatcagaaacaactgaagaaaataatatgactaaattattatagcctgatttaaaaaataaatccactgatatgcctggccatagtcaacttctccaaagataagtcatgatcattttgaggttttctttcaaagttagaaactaatcagtaacaaggttttggggtactagttttgtctttgaaaataattttatctcctgattaaaatttattttctctgattctcatattggcatatcattttttattagtttttactttgagaacagtttgaaaatgttaaactttgaatgaaatctgtggtcttcatttaacatggaaaaacaggttctgtcatcagttgaaagttctacatacttgttattagaagtttaatactcttctgtacatatccatgaagcaactaaaagctacggatactaaacattttgttgggcttatcaaggctccctgccttttgcaagtatttctttacaaccaatgatggttttgtatcctattctctttttctcattgactttactatagaaaacagtgcttcaagaaagcttccaataaacttaacatactaaatagattacaagccttatctatggtatatgtcagagatttggaatttggttataaatgtgtagaggcggtataatgtgggaatactggagtgaatttttctgagtgtagtctctaatttgaagcaaaagatgtgactatttttaaaaatcctgctgcagaatagatgcaaataatctctcatggaaaaaaccaaaaaccaaaaccaaccatctaacaaacaaaaacgtcttcctgatctgaagattgtatgaaagatgaagcacatctatgtttgagtgggtctagatgagataaaatgttaagagcatgtactagagcaaaaaaggattaagtttattattcacatttgctgtcgtaaatgtgccaacaggagtgttatcgaggaagagggataattgaaatcctaggatataagtagacaatttcttcttaaggtcattggttttaactcagaaagaatacaagaaacaggtggggaattttattaaatagcatgctccttccttttcagtcagatttcggatagccttctccctgactctacctgaataagaatcagttttttttgtttttttttagaatttaagggtaggaaaaaatttaaactgggtaagcattattcttcttgtactgccattttctccaaactcttattttggactattctttgagcatgaagagatcaacacatgaattttataaacacacaacagaaagttaaagaaaactctatcaggcataagtttatagagaacagatttgggaagagaagaatgtgtccattaaatatatttattggtcataggggtgtatactaactgtatttatcagcaaccactgagaagaagtgaaaataagcagactgaatttataggcatcgacatccacacatattgagatggctgaaggtgaaatgagtaatattcaaatgagacaaaatggacaactttaatttttacctaatagggtaagcactgtctctaaaagtgtggtccgtagacccctgcattacagtgcttattaaaaataggaatctccagctctcatcccagaaattctaatgaatctctggttgagacatggaaatcatatttaaaacatttacacaatgtaattcttatttaccctaaagtttgacaagcactaatggtgtaaagacatagaaaaagaaaaagaaatgtgtaagcctgaaagaaattaaaccataaatgaaataggccagttgttaaaagtagttctgttttatttaaattggtgtaattacatcttaatgggaggtgctctttcccagtcacctttcccttcaagggagaagagtactcatttatgcaacatggtgatgattaagaaagagaggataatttcagaaaggaggggaaactgaggggggagaacatagacattttttgcttagtttgtgtctgataaggaagatgactttatatggatcataaaaatctatttgtttacaggaaaaaccttggtataaaattaatgtagcagtgttaccctgtgacattagtcagtatggatactgaagagacactccttttaggcttaggcccagagttgctatatggttgtgttataagtatttagcatgtgctcacacttctccttcaactagaatcagccctgatccatataacaacttttagtgagttctcattgcatactaagtcctgtgtggaagaaaactctctgttgagcacctactatatattgtgtattttataaaatgcaatttcattaaattttggtaatgttttgataagtggttattgctttcattccttttaaaagatgaagcacctgtggctcagattgtctaggcggttagtaagtgtcgaatctagaatctaattctgatctttctgattttaaaatatacttttttccctgtaacatattgtctaccatgtgtaggaagctataagtagaatctttgagaagtttacagagaaaatagatggcaacagagaaatagaaaataaacgcacacatatccacacatggagaaaatgttggtgcatagatttaaaaaaccagaagatgtaaagactaatatgaaatcatgcacatttatgctgaggaaagaagtgtggaggtgtaattttactttcatttataagttttaaaaacattttaaaaaatgcattgcctgcccttatacaaccgactttgtatttaaactaaataaacagtgatctatcttttctgcactgtttcaaaggtgatcagagtatagcactttaactacatcatctctgttttctaaaaaggattacatttgctatattgtgaaaatcatgtttatcttagagcaatatttcatggaactaattcactggtctgcagtagctgtctgctaaatgaatctttgttgttctgtcattgttgtctgctttcctccaaaaatatgtcattgcttcaacttaaagagaaaataaatagaaacaatccagagaaacatgaaaaatagcagtgtcgtgtgtttccgtattagcactgagatttataagcatgcctgatggttttagtgcttgtgaaagaggtagattgaacagtcgtgaagcaggtcttctggaagggtaggaggtaaaatgggttctctggcttgttttatggctctatcagggttagagtttagagaaactgcacagagaagttcttcaagtgcgctcctttggatctgctctcattgaagataatagctaagaactgtgaagaatactttcacattttcaggttttaataggtttaaaatgactggactagagagaaggaaggttttaagaggttgagaaagaaaaatgggctgcagaaacactgagtcatgccagaacctgtaagcccaaccttcttctcccatgtacacacatggcctgtgtggtagggcaatttttagaattgcaattctaagatgatagaactaatcttagggggatccaaagtactatacaggcatatttaaattctattttgcaaccttttatctgaaaatgtcagatgatatctctgttttgaaactgcaaaagcagacacagagggatttagcactttgtttaaagttgaactgtgagtcagtgcaggacaaaataataattgctatctttagtttcacatgtactatctgccaactactgtcttaaaacatcatatgcatttaaactttatatcaacctatggttatattatcatactcattttacagatgagaaaaatgaggctcagacaggtaatttttttttgcccaggggtaataataaaaggcagaactgatggttaaccagggtctatctgacttcaaagcctatgctcttaatcacagtgctataccaccctcacaatgtctcctttgtctgcctaagtggttcttttactactttgatttaactgacttactgtcttaaaaggtgaaaaatttacattttcaagaaacattgttatggatgatctttaaagtagacctctaaggccagtggataggaagcattgctgtatgcattctctaaaggaagggaacaaaatgctcaaagatgagataatttgcatgtggccacaggaatgggtgagtcagtcaagacagagatgtagtctgtcctcccacttcacctgtatactgatgtcaatacagtcaaacagaagagttaaattaacaccggtggctacatgacccaagacatattattgttatttttattactattaccatttaagcttgtatgaaaatatgtggcccatttaaaattagttactttacattaaattttgtcaggtcacagttagtaaaatttagagagggtacatatcgtaacaataaaaatattatttgacgtaaatatgctacatatgtaatttcaacatatgttttctcatttggtactttacaacactgagaatcagataattttaatattaccatgactttacagctagggaaaccaaaaattaggaagactgagacttccaaatctctgctaagtgactggtagagctggaatctgagcacacctgttctcacatcagccctgtgctttctagtcctggcttctgccaggtcatgattctgggatcagaagtgcttctttggtgaagcacagataacttaccttggctttcaaaaaattactttatcttagtgtttcaactttcctaattcagaaaataccaaagataataaatgaacactttaaaaatatttcaaaccaatcttttaattatatagtacattcaagtcattattaggcatttggggatacattatttgattcaacaataaagctatatttggccttttaaaaacagggtaatgaattcttgtactaaactgtaggacaactggcagctgcctgactcaaatctctgaattggatgggtccgaagatgaacgctttttaaagttttctttactagttgaatccctttttgcactggaagcttaatgcagacccttgatgtttggagcagaattgctgtgggtggagtgggatagaggctagaagcttcctctaccttcctgtcttttattcccttaggcatacgtgaggcatctgagtggatttttcaacccaccttaaagctaatttttcattatgaaagaggaaataatgacaatggccaacttttgtggtgtatttactgtgtgcctggcatggtgccatctcccttgtgttactttatttaatcttcagaagaatcttctgagttaggtcttatcattatctccatttgtgggtggggaaatgtagatttagagaaggtgagtaactttcctagagccacctaactagtaacaggcagttaggactaatcccaagctgtttgatgcctaagcccaagtctttatccactaaacaagaaaatggaagtcatttgcttaaagtcatagagcttgttacaaagaggctcttgactagaaccttggtcttctgatatattaatattataattattaattgtatctcaaaattatgctgctagagaaaattaagttaaaatagtttaccatctttcacatatacagaatttgcaagagaattagtaaatacacgtcttcatgtcctcttttcccaaagatcattatgtgaaagtggcaatttcccttgattgcaacaatctgttttgcatattataatagtatcggatttagctacgagtgacaggaaacccagagtaacaggggattacataaaatggaattttattccgtttaatgtgaaacaattctggagataggcaggtaagagctaatagggaggttcacaaaataattaggaatctagtctcctactattgtgctgtcctaccagcttgattacgtgtcttccaaatcctggtctactgtggcaatccatgcttcaactagcacatatgtattctaactatgaaatgcacattaggattccagccaacaaaatagagactccattggaaagaaagtattcatatgctgactcttatggacaaggggcactatttgatttttctggtggctgtgtgcctaaccaaagatcaaggtttctgttattagaaaaaaaagaataaatatttgggataggcgtctaggagtttctagtatagctgtattaagtttgaatggtaagaggtatagcccattgtgatgaacataggctggtggatatatagttttgaagtgtaggcaagtgagctgagctgcagttatagatttggtagtcatcagtatatagatatgaattaaacgcatggacattggtaactaaaagtatttgttcttttgggtaaaataatgcatttcttataatttttatggtattaatttgcacagaaatcctactttattctaatatgaacctgagcttatttcactatgttattattaaatgccaatatattagaacgtaattgtcaaggtgagtatataataaaaaatttcataaattttatgtaccatccaaaaattaaaactgaattcttacatatatttcaggtcgataactggggcagaaaattctttaatcaggaaaactcacttttcattttggaagaattatttaaacatcgagagggtctatacatttttcaatttctcctcattgctgaattaattcagatagaattttgttacatgtagaaatttctagactgtctaaagaattcttggtgtatggtttagagtgctttctaaggaaacagcaagccagaggacacaacaaggtgtcagcatgtggcccaactgtcacattcaggcacattttaatcagggtctagagattttaaaaagttggtgtatagtagttatacatattttgggggtatctgtgatattttgatgcttgtatgcaatgtgtaatgatcaaatcaaggtaactgggatgtctatgaccatcttgtgttggaaatattacagttctcttctagctattttgaaatgcaaaacaagatattgttaactaaaatttccctactgtactgaatggtagaacttattccttctatctatacatttgtaccccttaaccaacttctcaatacaagtagtaaagtatgattttcaaagtctggctttctcaggtatggtatttagattgtttcaaataacttgtagtctcttagtttgactgcaaattatttcaaattatctgacattgtagtcaacagaaaaatgaggcatttgaaaaattgcctgaagtctgattgtttaacaaatgctgaattttaattaggatatgtaactttttgtgttatgtgaggcatggaacattagcttggatgaaaattgaagaccatttagatcaatttaaatttccgctgattttttaacatgtgaagaaaaggagagctctcaatatcatacaagttggggctcaggggatgctggaactcgtttgatgtggagtatgctctcagatttctcatctgtttgaactaacactaagacataggttactggttttacagtttagatctacttccattctatcatgcaaactttcttggagtcatctagacaatgtcaagaagaagatttggtaggaagacagctaaaattttaaaaagtttctgaaagtctcaagctatatattagcagccacaagagtgtctctagctcaggtttctcaatcatttttcttctgatacacttgcagtgatatcagcacactgcttgttaattcttatttttcttccacattttgaagtgtgtaaaattccctatgattggctgcaatggcatcgctcgttaactttgctgtgggatattgttgtgtataaagttgctcaggtaatgccagtttattatcttgaactaaaaagagtttgaggaaaagaaagcaaatatattagtagaattcaaacttcagtagcttagtttaagtctataaacccataactaattacttaataatatctttaatttttttgcaacccacctatctgtatgtagttgcaaatttctagagatcaggccaagtgtcaacttaaatatcagtttgtagtcacctgtgctgtaccatatttagttgggaacttaataaaaccttgatgataatcacagtggaggtcagagacattccttactgttgagttgccactaatatttatgtagtacacctatctaacaaagtctattgatatcatatgcaatcttcacaacctccttttaaaggtaagggaaagatactgtcacgtaagttttatggttggctaaacagaaatagttaaactctgggttttgtaacttctctatgagaactagccgtaattattatggtagggaatgcaaacattgtgattcagcccaagcgcctggctgatgctatcagatacttatagatgtgttttatcttccagtggataggacagaaatatgttatttgtaattttatgtggagtaatttgcttgtatttcttctttttttaaaaaaacagcaatgaaaatatataatccatgcacgtatatatgatattctgttttatttctactgtggatatttttatagtcctgttctagaaagtgtgagaaggattaattatgtcaccaatgcttgctggtttgggcttttcacaaagtaaaacacatctcaaatacttttgttgataggataagcaggcacaatcctatgagctaagctacggtcaaatacatatcatatgccaaaacaaatatatagaccaatggaacagaacagaggcctcagaaataatgccacacatctgcaaccatctgatctttgacaaacctgacaaaaacaagcaatgaggaaaggattccctatttaatcaatggtgttgagaaaattggctagtcatatgcagaaaactgaaagtggacctcttccttacaccttaaacaaaaattaactcaagatggattaaacttaaatgtaagacctaaaaccataaaaactctagaagaaaacctaggcaataccattcaggacataggcatgggcaaagacttcatgactaaaacaccaaaagcaatggcaacagaagccaaaattgacaaatgggatctaattaaactaaagagcctctgcacaacaaaagaaactatcatcagagtgaacaggcaacctagagaatgggagaaaatttttgcaatctatttatctgacaaagggctaatatgcagaatctacaaagaacttaaatttacaagaagaaaacaaccccataaaaaagtaggcaaaggatatgaacagacacttctcaaaagaagacatttatgcagccaacaaacatatgaaaaaaagctcatcatcactgttcatcagagaaatgcaaatcaaaaccacaatgagtaccatctcatgccagttagaatggcgatcattaaaaagtcaggaaacaacagatgttggagaggatgtggagaaatagggacatttttacactgttggtgggagtgtaaattagttcaaccattgtggaagacagtgtggtgattcctcaaggatctagaaccagaaatactatttgacccagacatcccattactgggtatataccaaaaggattataaatcatgctactataaagacacatgcacacgtatgtttattgcggcactgttcacaatagcaaagacttggaaccaacccaaatgcccatcaatgatgtctgttatacgtatctcatttcttcttcaatgatagactggataaagaaaacatggcacatatacaccatggaatactatgcagccataaaagaggatgagttcatgttctttgcagggacacggatgaagccggaaacatcattctcagcaaactaacacaggaacagaaaaccaaatactgcatgttttcactcataagtgggagttaaacaatgagaatacatggacacagggagcagaacatcatacactggggcctatcagtgggtggggggctaggggagggatagtattaggagaaatacctaatgtagatgatgggttgatgggtgcagcaaaccaccatggcacgtgtatacctatgtaacacacctgcacattctgcccatgtaccccaaaacttaaagtataatttttctttttttaaaagaccaactattgattggtggtattgctgtgaagaggcttcttctggtaaatttttctttgaaacactgagccttgacttgtcattttccagtgcttgccattagctttatttgcactagtacattttccccttgtctttttgctgttgctgctgcttttcttttttagcactattctaaaaattacacattaataagcaataataataatgcagcctaagcatattgcttgttttctggcaatttggggctaaaaaaacaaagcatactttaactgttatattcacttgacttgtcactaattatacatgtctccagattgaaaagaaaatcatataaagaaagaaatttgatattactaaagctgttagaattcaatcagtctatctgaaggtgattttacacgaataggtgcacataagttttgatagatgaaaatattgactggacaagtgtttatgtatgttcaggaggaggttaattatacaaacgtctgttgatatgtaaaataaatttattccttcactttactactttctttgagcatacttttttcacatctaatttggaggaattcagtattgaatcacttactgagaaaataaaaaagtaactaagaaataggatcaattatatctcaaaaaagctaaaaaatagggtgaatcagtttgaaaaacaatgctatacagactgggaaaagaacaaataatgtttcaagtgacaaacatcttagtaatgtggtcattaccactattactaataattaaaataatgatgatgataattatcatcctcgttatttgtacaatgatttttccacttgggagctcaaagtaccaaaccgccttctcatttttatctctacctagctcattaggttaggaggggtctggacttattatccttgtttttcatatggagaaattaagacagataattgaatctctgcgtacaagactatataataaatgagttggtggcagggctcagaaatataatctcttaattgtttattcaaagtatttttgactggattctctttttcctttgtcccatattatcccttttgtctacttctagccactcaggagagcatgtcactaaaatagttgtgagtaatgtggaaaggtgggggtcagaagaagaatcacagtggtaccttggacactgcagtgatgtaaattccatgaaaatacatatataatcttccttagtttttttttcatattttaagaatgtcctatgtctctcgctctcttttttttaattcaaacgccataatgttgttcttaaaaaatccaccataaaacaaacaaatccataaattaaaattaaaatttctcacttatttgttattcggcttcttactaataaacattggttgtgtcttctatatattttgttatgcacacacatatatagtttcattatttatgaaaaccgaaacatgaaatgcatattattctataactttttaaaattgaaacttatcattaacctttttaatgttaatacatgaaacctacttcatcaatagaatggctgcattgcttacatttttgtcttgattaaaacttactgtagaacaaatagaacgtgtctaatatttcacaattctatataacaatcatatacttttgataatttcatgttttctacaagcacacattcattttcttcatctgacatgttttgatattagttgagaaacccttctctccctgtattccccccaaagttttgcttacgtgtgttatacccatctcctttcttctgtaacagattaatagcaagcattcagggatgaaggaagaagagtcagttttgggggtttcttaggctcagttgcacataaaacataatctcattgtggagaagactttttatattgcagtaattgacattctaggaacaggtgtttggaattctactcaagggaaaactggagatgggaaaggttgaggagagtaagataaaagcttccctggttacggccccgtggaaaaatcacaggaacaaggcaggagaacaagcagagcccctggagccttccactacatctcagtccctttcccagggacaggattatacagcgatgataacaccattgacttctatgccaatgctctttattttgtgtccagccagagccaggatctaatgatggtgtgacaggggccaacatgataatattatcacttcctgatcctatatcatcaggaaacagagcgttcttgttttctgtaaacaaaaggcatttattgtgaaatgctttgctgtttacacgttcatgatctaattttaggtcccaaagtgctttagacggaatggttatcccgccccttactgatatatggggaaattgagctcagagtttaaatgatttttccgtcgctgatctgttaatgaaagggctgcacttagaattctccttattctgattcaacacccagtactcctccaggagaataccatgttttcctcaagtcctcatgtagcagacagttagcactctagaaaaaagaaaaaagcatagcacacactggcgtaaatacctcaagaaatctaaaataagagtatcatattcaaactccttagtcatctctgacttattatttcacatttctggctttagagtttgcttaccaaatattataacccaatgggacagcaactttaccaatcaaacaaaaatcatgtggatcaatgtttttcagtaacatgtatttttgaaggcagaacaaatagaagttgagggaatctcatgcaaaaagaatttcctgtagctttttttttttttttaagacggagtctcgctctatcgcccaggctggagtgcagtggcccgatcttagctcactccaagctccgcctcccaggttcacgccattctcctgcctcagcctccagagtagctgggactacaggcgcctgccaccatgcccggctaatttttttgtatttttagtagagacggggtttcaccatgttagccaggatggtcttgatctcccgacctcatgatccgcccgcctcggcctcccaaagtgctgggattataggcgtgagccaccgtgcccggccttctgtagcatcattaaagcttaaaggtaaatattagctcaaaacctcaggttctttaggaaggggcctctggttgtttcttctatgtatcctcaaagtttggtttggaaatagatcagaaaattagaagaatagaattagcaactccatgtgaaacctggtatgcttcaagctgtaacacacttcaaaggctatttaagattctagagtgctagagaaaaggcttaaaatatttttgtagcccctgcagtgtctaactctatatcaagtacatggctggctcaacaagtgatagctaacatttaatattgcacttttctacatgtcaggcattgttacaggcactttatatgtagtacttcatttaatcctcacaataatcatatgaaataggtactatcattatcatcttccttttatggatgaggaaacccaagcacaaaagtcaaactacttgcctagcaacaggagtcagagtcaggactggcctcagcagcctggaaccagggtgtgctctaaacccagacagtacacgaccctccaactgaatgtcctttattcccccaaaatatctgttttgtctaatgagtggatgtgttgcatgctctgaaataatctatctatttattttcttccttaggccagatgtggtgagggctaggaaaagagtttgttgggaaccctgggttatcggcctcgtcatcttcatatccctgattgtcctggcagtgtgcattggactcactgttcattatgtgagatatagtaagtataagctgccttggcatcatgtgatttaccccaaatatttcctcataccttgctgttttgatttgcctcaggcttattcatttatcactacgattcatttgcatagcctgtacaaagggatctttacctgctttctctcttatttagtcctcataagtcaaggaggattcttttttctatctttgatgtagtgatgctttctgctgggaacagcatgcttatttgcatcttccttaataagcaataagtgagtattaatcaaaggaaaactacaggatagctagaaccaatgtcttgagttgtttgaggtcacagggcaagcatcttgatttaaaataattctgaccgggtgcagtggctcacgcctgtaatctcagcactttgggaggctgaggcgggtggatcacttgaggtcaggagtttgagaccaggctggccaacatggtgaaaccccgtgtctactaaaaaaaaaaaaaaaaaaaatagccaggtgtgatggtgtacacctgtagtcccagttcctggggaggctgaggcaggagaatcacttgaacccaggaggcggaggtttcagtgagccgagatcacaccgctgcactccagtctgggcaagagagagagactcggtctcaaaaagaaaaaaaaaaaatccaactcgttgaagtcctgacatcccaataaatcaatgacacaatctggagtcataaagaagtaggctctattctgtaccagtaagttacaaaaatagtcatagtgatgtattgttgagtaagtgcctatttctgttattaaaatctcatcttaggatatattgtaagtgattaaagaggatagggtatgccaagaaagctaattataaagatgttcaccctgcggttatcaggtacctcattgctagatgaactgttagttgctatgttattagaaaggtctccagggtacttcagaactgttattctgggatgtaacagcccttctgaagtttcctcctactctgcctagggttttaattacttgactcaaccatgacctgttagtttaatatcttcctctgttactagattatacttggatgttcaaggcaccgtaaccatagaagctaataacttgattctaatttaattgggaccttgttgaagtttctttccagtaacgagaaagagtactctgtaacctggttatcttcctctactatccacgcaagtataatctcaatttacaaagcaaggtggatcatttctggatagtttaaaaaaatatttaaaacaaagatttttttggtagaatttgcatacaggcaagtctttaaatttggagtatctgcatattaataacagatttttctgtagcacactttttttttgctttttgagacggagtcttggtctgttcccaggctggagtgcagtggctcgatctcggctcactgcaacccctgcctcctgggttcaagtgatttttgtgcctcagcctcctgagtagctgagattacaggcatgcgccaccacacccggctaattttttctatttttagcagagacagggtttcaccatgttcgtcaggctggtctcgaacttctgacctcaaaagatctgccttccttggcctcccaaagtgttgggattacaggcataagccactgtgctgggactgaagcatactttaaataaaaatgaattgctggaataactttatagttctacagttctgctgagaatattgagtcctactttgttgtaagcatcattatttgtccccatggatgtctaggactgttttacacacttttgtgtgtctagaatttatcagaatcttggcacatgttatgtgctttataaatatttattaaatactgaatgataatatcaaatgaatcatgcctacaatattttcttgggccatacttcggcttgtctgacttcacaaggaattcctagtaacactaggggctaatcacctcagtgagagaaaatgtccctttctacttctcatttgcctcttcccaagccaagttttataagattcataaatcttagtcatatgtatacagtgaaaacttggcaagaattttttcagtaacctgttcctgaatcctgttgtttggatgatcaactgagtaatactgaacacacagcttctactgcccacacagtacacctgaataaacagtgattgttgtgatgtgtgttactgccttctatttgtgacctgctttctgttttgggatgtaaactaaccgagtggctttggcagacaaatatttagaagctgacatgccaaaataaccaaatcaaaccaaaccaaaaaaatctgtcacagaaatagacagatacagacaaaggtaatcagatttggaaaaatatcattttggttctcatttcataaagcccaggacaatgtagaattctgtgtatggttcgtgtctggggcctttgggggtgcatttctgcccctgtgtaatttggatgtcagaagatgaatctgttataagcaacatcactgcagattatagaatcacaaaactgctagaaatttaccaacaaactcatgtttatccttatttttaacttttctgttaatattcccaacatattttagtaactactcataccatatatttatggcagctggtaatatgttttaacagtggcatgcttaagtctacagggtaaagtaaaatactgagcacagataataaattgttaacttggttaaaccatatgaaattgccaatatttgactatttttgacctgtactaatggtgattttaaatcattcaatctaataagccaaaaaactacatttaagggtgtagaagggtctgttagcattctgtctagaatcttgctatttaatatgtgattagctaccagaagcatcaacatcacttgctagcttgttagaaatgcaaaatcttgagtctaactttagacctcatgtaccagaatgtgcattttaacaggctccctaggcagttcactttcacattaaaatttgaagcagaattctagaagaatggatacaactccacagagagttatagttaactatgaggcagatgttaaaaaatacaaatgtagtagaacagtagtttacagagatagttatgagttatttcccagtatttcaataaatttaaaatcttacttgaagttatgtatatttccaggtacctgcctgaatttcatgtcaccctggccattcagagaaagggaggtgaggaaggatggaggaagagtaaaacctcccaagtccttcacttaggtctcttgtactctggtgactcaactttcagtgtctcctgcctgccattcatctcttttattcatcaccaaccgcacccaagcccttgtcagagtctgatggctgcttccctctctgtcccatcaaatcctctggatggccagggtgttttatttgaaatacaccagtagttttttgcataacttttatacaacaaaagatttgtcctctagctttaataagtggctttttttcctactctaagaagcagcatgtgaagtaagtgggtactttgggagttagtcttggctatgtcctgctggacttgggcaagttatttacatttccaagactgtaatctattaaatgtggataacattgccttttcatggagttattgtaaattaaatgagatatgtgaatgtactagggacactggtgtccagtgttagtttccttttcttctgtggtttaagtgaagagggaaagaatagggaggaagagaaaggaggagagagactgtgactggatgagccacagtctgctttcctatagtaactatatacaactgtcttgatcaccagtgtatttctaatggttgacacagtgtctcttcctgaaaagtggttggcattaatatttgttgaatgaatacattaattttctgagggctgtctgcttgctttatgcactggagggtagaggaaaagttatatcacattaacttttcagcaggtcaaaaatgtgggttgcttaaattgaatgcagaatgtagagacagtggctaaggagcagacaagccaacccctgtggttggtgggaaaaacatacatgcagtgacaaaggacccaggtgaaactaaatagtgtccctggaaggttatgccaggtggcaactttagctccctaaacttccatttactgaatcccttgcattttaattcctaacctcatcttccttttcagccaaaataaattttctcaaactagagttcttgcggccagaattgatgtatagttgatggaagggaaaagaaaatctatgtttggaatataaaaatgcagtgacccttgggaggcttctgaatccatccctgtttgtatgctcagatggcatgacttgctgtctcttgtggcttacttaggaatgagtaacacatgaataatcagcccactgttccaatgagctacttgtacagtactccaggaacaccaggcatttcttacagcttttattctctaaatcacatgatgataaatgttgttgttttttatcctgagataactatgaggcctggggcaggatgatgatgatgacctgtgctaagagcattccttcctgtttcagtcttccagcaaccaccaagcggggatataatgatgctttacacacatctgataaaaattatgatagtgttttgcttctttccttgtagatcaaaagaagacctacaattactatagcacattgtcatttacaactgacaaactatatgctgagtttggcagagaggcttctaacaattttacagaaatgagccagagacttgaatcaatggtaagcaacttgtcatctacttctagtgcatttgctttcactttttaccatatttttagcatcctagcttctaaaagatccattcaactaacggatccctgtgtatttgcaaaatgaaaagaggccctaacccaaggaatataaaacaaaatggacaatacatcacttagcacaatatgactcacagggttgaaccaaagaaactttagccattcggtcaggtccttcttactcacctttccttagctagtgatatactcttgatcagtagagtccagagattctggaaatgtgagtgtggcttaaaatatatttgttgtatcctagacttcctaaaaaagagaccccgagcagaagattgccaagattgaaactatttaggcacatacctaaatagtctgttaggttttaaaaatatctaaccttcaaccagcttttggtatataaatctgtagtaaatccacagatatgcaactctacccagtttttaaaaatatttaaccttcaactagcttttggtatgtaaatccacagataagcaactctacccttaacgcatcaacattcatcttgagggatcaattaaatacttaagaaactggaaaaattagcagcatgggccaaaagaacaagggcctaagtggtaacttcttgtcattatcagattaattaaagaataatttaacttttcctggaaacctgtgaggtaattcatgatataatgtgatggaaagaacactgaactgggagctgggaggcacatgtatctccaatggtatctactaggtaatgatacatcacttggaatattagtttatcattctgcacaaagttctgtaaattgaaaattaaggtattaggttagataatttccaaattgtcttccagttccaataacctgaataagaatggaagtgagaccctggaaaccgcccagtagacagaagcctggggatttggccaccttgctgagacagtggttgaatcctggttacatttgcacttgcaaacaccaaatcagggaaatatttgaccaggctcttctctaaggctaaatacatatgcaaaatgaaggaaatgaaattgaattaaaaaggtcaagaagagatgccactatttcccttgttctttgtgccattcattcaaataaattttatttaagtaaataaaatccagacagatttaaatctaaaggaatatacataaggctctttaatgccttcaaaattaataatagttttgaagttacttgacaaaaattaacccttaaataaaaattttcttgtgaatactgccatcctattcagaggacttctgctattcagctttgtctcataatcgcaagaagtgtccttagtaaaaaaattcggaattaataaaatgtaagaaagaattaaaaggctcattgcttctgttaatcaccagcatgtagtaagtgtttactaaatatccacatactggaaacaagacacctttgagtgtttccttacataaactcctaattaaaaaattaagttgcctagaattcttatttagaataataactaacgtctctacaaaaatagactctttcactttagtagagtaaaactcataggtgtgttaggctaagtatcccagttcacctgggcctttctaagagcacttggagtgctgaacttcgtgtacattatgccaggaaaactgacaactttgtcactaggtttgggaagcatttgacatggtcatgcactcatttctataatccaagtattatgtggcagaattatttcatttcctttgtctatgggcagtaaaagtccttacttcagagtaaaatttctcactcttaattttgaagaaacagcatgttcattttctttggtctctttctgagcattagtacagcagatatcacttctggccccactgcggttccctactcctatcattcctaagacagcgttcagttgaaatcactgagaaaaccacaatagattcctcaagcttcctcagttccactcactgtgaaatgtcaatgttttttgctctgttttgttttttaattttctaaaaagctttgaattaatttgtggaatttcagaaagttgttcttgctgatatattttgaatatttttacaaacaggtgaaaaatgcattttataaatctccattaagggaagaatttgtcaagtctcaggttatcaagttcaggtatgtaaatctgaattgctgacttctgaatttaaagttgaagctgttaatctgctcagcaataaatatgttttcaagtgttaaagatataattcaatccaacaaacatttgacacttgtcctgtgtaagtcatgggttacaaagtcccttattcattccttaaatcccaaagtaagcatttgcaagatggttgctggggacagaggtataattggtgcctatgttataaaattgttttctgggaaacttaccaagtacagatagtactaaatacagatagacctaacacacatccttggtttaatggcaagtagtgccccatgtaagacaatatagtagatcaggtttgtctttagctcttcttcctcctattaatcaatcttctttatcttcttctattccatccctccattctcaaaatatgtagctgagaaaatctcatctgtcaactaactattgataaatgggtttagtacataatgttaaggaaaatattataagaattttcaataagatattgacataatacaaattatttgtattaaaaaacagaataagaattatttccaatattattccaatgacaaaactttaaaagtttcctgccattctattacttagctgatatctctaaggcattactttgatcactgtcttctaaaaattctgtactctctggtgtttgagatactgccctttcttggatctgcaactacttctcttatctttaagtttcactttctcaaagggacctcattcacccacatggtctcatatgctattgaaatacaagtttctatctctagtctgaactatttttctgatttctataactatatacacatccccatgtggaagttccacagaaaattccctaactcaggaagaatccaatcacataaatgagaaacctggaagtcatcaaacactccttcctttcctggtcccctcatactttatgaataactaagttccactaattctattttcccaataactttccaatttgctcacctctttattccagtaatcttgctactgctactcattattctgtcttctgttactgcaatagtgagaagagcaagtttattggaaagatgaagtcaattttggagatgttgaatttacattctaagggaccatatgaacctgaaaaatgagggtgactcagtagagggaaatggaactgagcagaagatagaaatttgctcatgatcaactcaaaaatttggaagcatgggtgtaaatttctcagaaaaagaataataaaagggaatgaaaaggatgacaaagaaagcttgaagaccaatatttaaggtgatggaaggaatataggaaacttagatatagggaaagagcaggaaaatagaaaaatcatgacagaatcaccactgatgcaaaagataagaagtttcaaagagagtgtggtcggcattgacaaatattcctgactgagtaatataaatattgaaaagaatccactggctttgtcaactaggatacttgggttgttacttattttcgtgtcctgaaaatagtgttacaattaacatgtttataggtatgtccttgcacaaatgtatgagtgcatttgaatgtttaatttctagaagtggaaatgctgtgccagagaagacagatattcaaacttataatagataacactgccatccaaaaataagactctaatttgtattcccacttccagtttatgagagtagtggttgatgcaatatatagtgaagagttagattcagaagtgactatgaaaaggagtgggtaaagtagctggcaggatgattccaaggtagtaattcatacaaatagtattaagactaattaatgctctgtgttgaaaatacagtcacatgaagtcagtacaatttggtaaagcggtcttatatctttaggattaggagttgtttaggatagcctgaagattgtttaggggaggtaagtagacttgagtcacaagaataaaacctgaaattcaaaaccacagttgatttcatatttaagacacactgtatttgataattttgaatggtttttgacaaggtgtctttttatattaatagccatatacttaactagaccttttgatggtaagggagaccatgaacagactaactcactatatgagaggctgaatttgtggttcttcacatagtaaacagtagcaatatagaaggaaacatttatggatgtattttatgtgtgcatttcatgtaagtgataaagaaaaaagcagattgtgatattacccttctttcttttcttttctcttttcttttctttctctctctctccctctctctccttcctcccctccattcccttctcttcacttcctttttcctttcccttctccttccttccttttctcttttctttctttcctccctccctcctttcttcacttcctccttccctccctccctccctcccttcctgcctttctttcttcttttcttttctttctttcattttcttcttttttggcccacagtcaacagaagcatggagtgttggctcatatgctgttgatttgtagatttcactctactgaggatcctgaaactgtagataaaattgttcaacttgttttacatgaaaagctgcaagatgctgtaggaccccctaaagtagatcctcagtcagttaaaattaaaagtaagttaatttctcttatttttctttcatagaacagcttcatgttaggtttgatcttggcacttattaaaaaattttttttgatgtcctttaattctggggtcttgccaccaacagtatatttctttggaactaaatttgtcctaatgaagtattttaatttttaagactaccctaaacttaggcctcccatgcaagctttttattaactccttagcagttttctttatattacactttatagtttggctatagaatccaattataagtgaagaaaatggctttgtattttcttctttttcttgttgctttcattgtatgttctgagggtgtggtatatggaaaggttcatgccatttacacatttgttttcaaatgtcattaatataccttgctatactttcttcccttaaacttttcaccagtgaaacatttataataaacttatttttggtatatttacaactataaatgaaaaatttaggtagatttttgttgttcttgttgttattgtttgtagggccacatgggacaaaacaagtgatgataggtcctcacatttagaaaataagaaatatgagatcctcagtggaaattaagatctggctaagggctggttcatatgttacagaacaatgaaggtctatagaaatactatctgggcacaagtataatgttacattttctagaagttacattaaaaataaaaataaacatgtaaaattaattttcaataatttgtatattcaacccaatatgtccaaagtattatcatttaaacaaatagtcaatgtaaaaattattcatcaaatatttcacttttttttgtagtaaggctctggaatctagcgtacattttatactgatagtacatttcaatttagactagccacactgcaaaagctcattggccacaggtggctagtggatacagtagtggatatggcagcactggaaactacagagtaggggacaagtagagagaatgaatacaaactgctaatataatatctgatagatctaagtagatgcctaaattgatggccagccaacccacttgcttaggaaggaggcttcagtagtcagggacagatacataatttatgcgccttagcacaaaatgaaaatgctagacctgttttcaaaaagcaagaaaaaagtgctgttaaaagtacaaagatataacacttttctttcttccctggtctcgctctcgactttccatggtgttttcatttgctgattattgtcattctaagagaaaaaaattaaatttgtagattactaatatgagtttaattgtttatatcatgcaatgtcgatataaatgcatatataagtacatttaacttgtatttcaaatcatggaaattatgcaactatatttcgtagcttatacatacatgtttttcatttttgcctcaatggaaatagtacaaaaggctaatgactctttttattttcctggttaatatgagaaaattctaccaacactctctaccttcagcttattgaggggtgaggaaggactagaaggaaaaggagatctggatttccctatctttctctttctacattgtagttttcagcaaaagttgttggctaatacacagaagtaacagaagcaagaaaggatatggcaggatctgttgttcatttgtgtttattagaatgctattgtcttttctatgggttctaagcaagttttggttcaaacagaaaacatggcctccaaggcatgtcagtccacctctgcttacttaatggaagggatagcacacttaccttgtacttgctttgagtcttgctgaacccctgtggattgtgggtccactagaattctgatttcatagggaattgtgaatgatatatgcaaatggagtggaaagaaactatggacacacttattgcacatatcttgtctgccaacactataatccattatcctattgaacttcattttcaaaacacaagttacaagataaaattattaagaatgtcaagtgagcaatagcagagcattgtaccaagcacaaggccattgtgagtgtgagacccagtgcagatgtataagtcacacatgaagccagccttgtcagtgctatcaatactcagagcttgacattttcctaggaagagcttgagatagagaacaggttatttgaaacaaagagatcagaggtggtccttttaatattaactgagactaaattgtaaattcttccttatttttgccattttccccacaagtagccagaataaataaagtcagaaagaaggccttctagaatatagatttccacttcattcatactattaaatactaaagaaaaaaattaacactaatatttttgcatttagagcatccatccttccatgtacaaagaatagttttggtcattagaactctgctgagtcagaaagtttgagcttagagttttatgtatctattagctgggttagtgtttgcatagggtttgagactgactagtgagaagtcagcaagctaagaagtcattggctggagctaaatgacaatttgagggcagactgtcttttgaaatttgacttcaaaaagggtaacattgtttttaactgtgagtgagtacaaatttatggagatgctactcaggtgtgttatacaaatgggactaggcttatgagctcaatgatacaatctgaaataatggttaataaaggtattgttacatttggggaattaatactatggtttagagtagtatttcccatggaggggctgtggactctctgcatcttatttactggtataaaatccaaattcttgggcgtcattacaagctactgaattagagttactgggaaggtgaacaggagtttcattataaatatgcttcctatgtgactcttacccacattaaagtttaacacaccgttcacattctctgcaatgtgatgatcatcctatgtctatgacaagctatgttgccttctttataatctagagatactgttttataataaaattaagcagccttttagtatttgaaatactcggaggcatagtgtaactctgatgtgctgaccctatttgccatttctgtgtgtttcagaaatcaacaagacagaaacagacagctatctaaaccattgtaagtttaatatatttattgaaatagcattacctgaaggtaaaaagctaacactataggtcatttaggtttactttgtgttgatatcatagggacagaacacataaagtttgattaatttgtgtacagttcatggtactttatcatatcttggagatacattttattagtaaaggatagcaaaattgagataactttggagtggatgtatgggtgcctgtggcagatgtgtagtggaattgagttgtacagctgttaaagaagaggcaagaaatgtttacttatcaatgttctgtttgtaggtatctataagataaaacaaatctatacattgtgtttttcagctagaggcagaaactcattgtcactatatcctagataaaatcttcttgatgttattaatcctacggattaatacgaaagtgcaggaaattatcgggtcgtggaagagtcacagaaagtgcaggaaattatggggtatattttaataaaattactgaagacacatagataatatcttcacctatattataaaagtgctgagtctaggcctagcacttttcttctcctatagccaagtatgccaccatgatttacagtatacattcaatagttatggggttgttgcacattacatttctcttaaaaggtggaaaaatatgtgctactcaccagctcatatagttggttaatttctaaaatcaactaaacacaaaaccaaaagataatctcattacctaaatagcatatattctcaccaccaatatttattgggaacctaccatgtgctagcactgtgttagacaacaggcattccaaatggataagatataatatctctacctgaagcaccttatactttaatgggactaggtgcatgagactaattcatgaacacatcattcttaaacaacacttctcaaccaagggaaatattgttggccaagctatcatgccccactgtggcatttttgtcatgaatatagggggagggctactggcatctacagtggatctacagtatataggccaagatcttatgatgcacagggcagccccctacaacaaagaattaaatggttcaatatgttagtggtgctaaggttgaggaaccctgtcataaacaatgtcagtatgtatacatacacataagcacacatacagagtgtgtttgttatacacataagcacacacacagagtgtatttgttactattattattttggaagcaccaagaaagtaataactaatccagattggagacaggggagttagagaaagcatcctagagaggtaacaactgatttagattttacaaaatgaacaggagttagctaaataaaacattacagtttacagaaaggtaagagcatgagaaaacatttgatacttttggagcacaaagtagaagaaatatgggacatagtaacacaatttgatgtgcaaaacaactgctaattaatgcacccaccaatgcaccccccctctctcttttgcaggctgcggaacacgaagaagtaaaactctaggtcagagtctcaggatcgttggtgggacagaagtagaagagggtgaatggccctggcaggctagcctgcagtgggatgggagtcatcgctgtggagcaaccttaattaatgccacatggcttgtgagtgctgctcactgttttacaacgtaagtcttgaaccttgagaatgattgggagtgaacaaagtgcactgggttttggcaagaaaatacctcatgaattttgggagatatgagtttagcataaattaaaaataatgtgtatatcacaaaagactggatcatttgtaaacattagtaagaggttttaaagtctggaaatggaaatggagtcaaagtatatgtaaataaataatcttttgataaacacacaatagtttctcaaagaaagcaggaattttaaagtcatttttggatttgaatttgctgtcaaacaggagtgctctatctctgctgagtaccttaatcagagatggagtctggataggttgtaggtttgatcctaagggggaaatttcacatggtaagaaaaagaattaaatacgaagaattatgtaatgaagatatgaagaatttggaagtagcaagttgtataaatgaatagattgactaattatattgcaagaaatggaggacccttcaatctattgtcaaaatgtctatagtatataaaataataatactttgttaaattattgtgtggactttttggttttcagagaaatgtgtatatttctgggtggggtacatgagacacatagaatatattaatttctcttattctgtacagggtactttccataggtcccttggagtcattaatatacagaaaaatcaaaaagccttagcatttggagtggatgacttggcatatggagtggcatgtatattataggaaatggtggctttttcacctggtcagaaccctgagccttattatcaaattggaaagagttctatacatcaaaactataaaaagaaaaaaaaatctacacctgtagactaaattatttaatataaattattcgactggtagcatggtaaaaagaaatttattcttcatttttttctccccagatataagaaccctgccagatggactgcttcctttggagtaacaataaaaccttcgaaaatgaaacggggtctccggagaataattgtccatgaaaaatacaaacacccatcacatgactatgatatttctcttgcagagctttctagccctgttccctacacaaatgcagtacatagagtttgtctccctgatgcatcctatgagtttcaaccaggtgatgtgatgtttgtgacaggatttggagcactgaaaaatgatggtgagcgtcggaagaggaactcaagtaaaagttaaattggtattttatggcatttaagcaatgaaatgccattatgccaaaatatgttagttgtgtggtcatatgacctggaccaagtcaggccctaaaagtgaagtaaataacttggaaggcacaaaaattccttcctgcctaagttaatatcgagtaaattgctactactatatactacagtcatagtactgctaagatgtctgaaaaagcaaatatgtctcctagccatgaactttctttagagaattaaccagtttagagattagcaatcaataatatacccaattctgaagattggagaatcataaagccaccattctcccctactgaaatttccttgtaatgttaacaatggagtggacattatttagataacttgtggttctttcctaggcacccaactttttgctcaaagtagttaggaacaaattatcttcccaaatattattgttctaaacatatgtagtctaagattctgtatcactatctttttttttttttttttttttgagacagagtctccttgttgagacagagtctccaggctgaagtgcaatggtgcgatcttggctcactgcaacctctacctcacaggttcaagcgattctcctgcctcagcctccccagtgattgggactacaggtgcccgcctaatttttccatttttagtagagacagggtttcaccatgttggccaggctggtctcaaactcttgacctcaggtgatctgcccttctcggcctccgaaagtgctgggattacaggtgtaagccaccgcacccggtatcccccgcttttttttttttttttttttttttaagatggggcttctttctgtcccccaggctggagttcagtggcccgatcttggctcactgcaacctctgcctcccgggttcaagagatttacctgcatcagcctcctgaatagctgggattacaggtgcatgccaccacccccggctaatttttgtatttttagtagagacaggatttcaccatgttggccaagctggtcttgaactcctggcctcaagcgatcctccaatctcggcctctcaaagtgctgggattactggcgttagtcaccgtgcctggcctgtatcaccatcttattcctaatcatgaaacattttcttcaagtttataaaatatatgtatgtctacaaatacaaagacttttttttcttttaggttacagtcaaaatcatcttcgacaagcacaggtgactctcatagacgctacaacttgcaatgaacctcaagcttacaatgacgccataactcctagaatgttatgtgctggctccttagaaggaaaaacagatgcatgccaggtaaacagttttgcccattagtatgttgtgtaattttttgtttacttttctttgaaataattatatatctacaggaagttgcaaagatagtacagaggagtcacaacatctcacccagttttctccaatgattacatctcacataactatagttcaatataagatctgggaaattgacagtcgtacaaagtatgtgtctaattctatggcattttgtcacatctgtagatttgtgtaaccaccactacagttaagatgaagaactattctatcaccacaaagacctacctttttccctcctcctactatccctaacatctggcaatcactaatttattctccatctctataatttttcaattttcagaatgttatataaatagagtaacagtagctttttaaacagaatttaattttggatcatctattggtatttttggcttttttttgtagaaaaattttagtggttcctttaagttatatatatgtgtatataaatatatatttatttatatatacatacataacatcactgtctatgtgtattgaaattttactagttttggtggagtatagaataaaaaacttacttccccttaaatccctttgcttttccctctttaatattaaacattaacaaatataaacattaaatattaataaatataaatattaaatatttgctttatattttgagaaccacagaagacaatgttttgcttcaacagtcaaatgtaatttagaaaacataagaggaaaaggaaagactatttacctatggatttcttctttcctctttcctgattccttttttaaaaacagtcatttctgttttaggaacttcttttagccactcttttagtataggtatgctggtgaaaaattctcctagattttctttgtctctaacagtctttatttcttcttcattactggagcataatttagcactgacagttcttttctttcagcatttaaatcattgcctctgtgatttctgcaaggaatttgctgctattagaattatttttttccaatagatgaggtgtcatttcttgctgtgttcaagagtttgtctttagttttcagaagtttgattatgtatcttggcatggatttctttgggcttatcctgtttgaggtttgctcagctttttgaatatgtagatttatatcctttgtcaagtttgagaaattttcggtcattatttcttaaaatactctttcagtcccaccttctttcttctttccttctggaactctaaccacagcaatgtttactcttttattatagtcccagagtttcctaagcttttgtttattttttttgcactctagtttctctctgtttttgagattgggtaatttcaatgtatcttcaagtttactgattctttgctctgtcttctctattcttatgttaagcccatccagtgagttttgaattttgcttatcatattttttagttccagggtttttctttgtttcttctttttatatttactatttctttgttgacacttcctatttcttttcctttgttttaaacatgatggtaattgctcattgagatgtatttatgatggctgctttaaaatctttgtcaaataatttcaacatttgtgttatctcagtgttggtatctgttgattgccttttctcattcaagtaaaaacttttatatttcattgtatgatgactgatattcagatatatgctgagcatctaattattatttattctgttttgttgttgttgttatatcatgcttttaaatttatattattttatttaattaattactttgcttcttccaacttttattttaggttcagaggttacatctgcaggattgttacatgggtaaattgtgtgttgctggggtttggtgtacaaattatttcatcatgcaggtagtaagcataataaccaataggtagtttttggttctcatcctcctcccaccctcaaccctcaagtaagccccagtatgtattgttcctctctttgtgtccatatgtactcaatgtttagcttccactcataagtgagaacatgaggtatttggttttctgttcctgcattcatttgcttagtataatggcctgtggctgcatccatattgctgcaaaaaccatggtttcattttgctttctggctccatagcattccatggggtatatttaccacattttctgtatccagtccactgttgatggacattttaggttgattccatgactattgtgacaattgctgccatgaacatatgcatacatgtgtctttatggcagaacaatttgtattcctttgtgtataatatacccagtaatgggattgctgggtcaaattgtagttctgtcttaatttctttgagaaatctccaagctgcttcccacagtggctgacctaatttacattcccacgagcagtgtataagcattcccttttctccacaacctcaacaacatctgttgtttttttgactttttagtaatagccattctgactggtttgagatggtatcttattgtggtttttaatttcccatttccctgattagtgatgttgagcatttgtccatatgtttgttggctgcttgtgtgtcttcatttgagaagtgtctgttcctgtctgtattaggctgttcttacactgctataaaaaaatacctgggtcgggcatggtggctcatgcaggtaatctcagcactttgggaggccaagggaggtggatcactagagctcagaagttcaagaccagcttgggcaacatggggaaatcctgtctctgctagaaatacaaacattagccaatgtggtggtgtgtgcctgtagtcccagctacttggaaattatgaggcaggaggattgcttgaacccaagaggtcgaggctgcactgcacccactgcactccagcttgggtgacagagcaaaaccctgtctccaaaaacaaacaaacaaactaacaaaaccaagtaaacaaaaagccaatattaggtaatgtataaagagaaaaggtttaattggcttatgattctgcaggctttatgggcagcatggtgctggcatctgctcggtttctagggaggaagcttacaatcatggcagaaggtgaagtgtgaaatgggagggagcaggtacatcacatggtgaaagcaggagcaagagggatagagtggtaggagaggtgccatacacttttaaacaatccgatctcacaagagctcactcactattgcaaagataactccaagccgtgagtgattggctcccatgacctgaacacctcgcaccaggtcctaccttcagcattgggggtgacaaagcaacatgagatttgggcagggataaatatccaaattatatcattctgctcctggcctctcccaaatctcatgtcttctcacattgcaaaatataattatgccttcctaacagtccccgaaagtcttaactcattccgactttaactcaaaaattcaaagttggccagatgcagtggctcacacctataatcccagcattttggaaggccaaggtgggtggatttcttgagcccaggagtttgagaccagcctgggtaatgtggcaaaactgcatctccacaaaaaaaaattagctgggctttgtggcatatgcctatagttccagctgtttgggaggctgaggtgggaagattgattgatcgtgggaggtttaggctgcattgagctgtgatcgcaccactgcagtccagcttgggtgacacagaaagacttcattttggggaaaaaaaaaaagtctgaagtccaaagtctcatctgagataaagcaattcccttccacctcatcaatctggatttcactgtcgatgtaactatcagcattttggtcacaaccatttaaccagtttctaagaaatttcagacttgatcatatctgtcttctgagccttcaaagttcttccatcctttacctgttacccagttgccaagtcgctttcacattttccaatatctttatagcaatgccacactcatagttaccaattttctgtgttaggctgttcttgcattgctattaagaaatatctgaggccgggtaatttattagaaaagatgtttaattggctcatggcttttcagactttatagtaagcctgatgctggcattaacttggctcctagggaggcatcaggaagcttataatcatggtgggaggtgaaaggggagcaggaacatcatgtggtgaaagcaggagcgagagagagagagtgggaggaggtgccacacacttttaaacaaccagatatcgtgacagttcactcgctatcgcaaagacagcactatgctgtcagggatccgttacccaaacaactcccaccagcctcacctccagcaatggagattaaacttcaacatgagatttgagaggggacaaatattcaaactgtatctatgttttttttccccattttaaaagggagttgtttgttttttgcttgttgatttgtttaagatttcttaaagattctggatattagacctttgtcagatgcatagtttgcaaatattttttcctattctgtaggtcgtctgtttactctgttaatagtttattttgctgtgcagaagctctttagtttaattagatcccagttgtcaatttttgttttagttgcaattgcttttagagtctttgttataaaagctttgttaaggctgatgtccagaatggtagttcctaggttttcttctagagtttttatagttttaggttttacacttaagtatttcaaccatctcaagttgatttttgtatatggtgaaagaaaggggttcagttttaattttttgcatatggctagccagttatccccagcaccatttattgattagggagtcctttccccatttcttgttatggtcagctttgtcaaagatgagatggttgtagacatgcagctttacttctggcttctctatttggttccattgatctatgtgtctattttttttgtactagcaccgtgatcttctggttactatagctttgtggtatagtttgaagtctggtagtgtgatgccaccagctttgtttttttgtttaggattgctttggctattaaggctcttttttggttccatataaatattacaacagtttttactaattctgtgaaaaatgacattggtagttttataggaataacatttaatctgtaaatttctttgagcagtatggccattttaacaatactgattctttctattcatgaacacaaactgttttaccatttgtttgtgtcaactatggtttctttcttttttttcttgagacaaggtcttaccctgttgatcaggctggagtgcagtgccacaactatagttcactgcagccttgaactcctgggctcaagcgatcctcccacttcagtctcctgagtagcggggactataggcattcaccaccacacatggctaattttttaggtttttggtagagatggagtcttgccatgttgctcatgctggtcttgaactcctgagctcaagcaatcctcctgcctctgcctcctaaactgctgggattacgggcatcagccactgtacctggccttcaactatgatttctttcagcagtgtttttaattctcattgtagaggtccttcaccttcctagttagccatatgtctatgtattttattcttcttgtggcaattgtgaatgagattgcactcttgatttggctctcggctaagatgttattgttgtatagaagtgctcctcattttagtacattgattttgtattcagaaactttactgaagttgtttatcagttctaggagcctttgggcagagactgtggagttttctgggtgtagaatcatatcatttgtgaagagagatagtttgacttcctctcttctatttggatgccttttatgtctttctcttgcctaattgctttggtcaaaacttccagtactatgttgaataacagtggtgagactgcacatccttgtcttttctggttcacaggggaatgcttctagcttttgcccattcattatgatgttggttatggggttgtcatagaaggcttttattattttgaagtatgttcctctgatgcctagttagttcaaggtttttttcttttttttctttttgagacagagtctcgctttgtcacccaggctggagtgcagtggtgcgatctcagctcactgcaacctctgtcccccaggttctagtgattctcctgccttagcctcctgagtagctgggattacaggtgccaaccaccatgcctggctaatttttgtatttttagtagagatggggtttcgccatgttggtcaggctggtcttgaacacttgacctcaggtgatccacacatctcggcctcccaaagtgctgggattacaggcaggagccaccgtgcccagacatatttatttattttcatatgttgaaccagccttgcatcctagaaaataagactacattactgtggtggataagctttttgatgtgctgctggatttggtttgcaagtattttgttgaggatttttgcatcaatgttcatcaaggatattgtcctgaagttttctctttttgttgtgtctcttccaggttttggtatcagaaaaacactgccttcataaaatgtgttagggaggcttctctttttctagaattttgggagtattttcaatataattggtaccagctcttctttatatatctggtagaatttggctgtgaatctctctgttccagggccttccctgttggctgtttttttaaaattactggttcaattttggaactcattatttatcttctcaggtattcaatttcttcctggttcaatattgggagtttgtgtttccaagaatttatccattccttctagattttctagtttgtgtgcatagaggtgtttacaatcatctttgaaattttttgtaaaaaatatttctcttccctttggcatttctgatggtgcttatttgaaagttctttcttttttttctttgttagtcttgctagcagtgtatcaatcttatctattctttcaaagaacaagttgtttggtttcattgatcttttatatggatttttgtgtctctatttcattcagttcagctctaattttggttatttttgtcttgtgctagtttaggggttcacttactcttgtttttctagttcctcgaggtgtgatgctacattgttaatttaagatatttatatcttttcgatgttggcattttgccccataaactttcctgttaatactgctttacctgtgtcccagaaattccggcatgttgtatctttattttcattaatttcgaagaatttcttgctttctgtcttaatttcattctttactcaaaagacattcaggagcaggctgtttaatttccatgtaattgtataattttgagagatcttggtattgatttctatttttattgcactgtggtctgagagtgtgattggtatgatttttaaaaatttgtttagaattgctttatggccaagtgcatggttgatcttagagtatgtgccatacatatgcagatgaaaagaacgtatattttcttgttgttaggtggagtgttctatagatatctcttaggttcatttggtcaagtgttgagtttaggttcggaatatctttgttagttttctgcctttataacacctttagaggggtgttgaaatctccactataattttgtatttatctaagtcttttttgtaggctctaagaacttattttctgagtctggatgctccagtgttggatgcatatacatttagatagttaatcttcttgttgaattgaacactttatcactttgttacaccattttttgtcctttttaattattgttttaaagtctgttttgtctgaaataagagtagcaacccctgttcttttttgttttttatttgcttggtagatctttccttatgcctttactttgagactatgagtgtcattgcatttgagatgggtctcctgatgatagcatacagttgggtcttgcttctttatccaatgggctactctgtcccttgtaagtggggcattaagcctgtttatattcaagttataatattgatatgtgaagatttgatcctgccatcatgttgctagctggttattccacaggcttgattgtatagttgcatatagtgtcagtggactatgtaattgtcttttctgtggtgtcaggaatttttttttttttttgagaccgcgttttgctcttgttgctcaggctggagtgcaaaggcgcgatctgagctcactacatactctacctcctgggttcaagcgattcttctgccttagcctcctgagtacctgggattacaaatgcatgccattacacctggctaattttgtatttttagtagagatgggatttcgctatgttggccaggctggtcttgaactcctggcctcaggtgatctgcccacctcggccttccaaagtgctgggattacaggcgtgagaaaccatgcctagccaggtaatggtcttttgttgccatgtttagcactctcttaaggactttttgcaaggcaagtctggtggtaataaattcccttaacatttgcttgtctgaaaaagattccgtttctccttcgcttatgaagcttagtttggctggatatgaaattcttgattggaatttttttctttaagaatgctgaatataccagcctggccaacatggtgaaaccccatctctactaaaaatacaaaaattagccaggcatgctaatgggcgcctgtaatcccagctattcgggaggctgaggcaggagaattgctttcacctgagaggcagaggttacagtgagctgagatcatatcattgcgctccagcctgggtgacaagggtgagactctgtctcaaaaaaaaaaaaaaaaaaaaaaaaagaatgctggctgagtataggtccccaatctcttttggcttataaggtttctgctgaaggttctgctgttatcctgatatcaccccctttgtatgtgacctgtcccttcgctctactgcttttaagattttttctttcatgttgaccttggagaatctgacgacaaggcgtctagaggatgggtgtcttgtatattatatctctggggttctctgaatttcttgaatttgtatgttgacctctgcagcaagattggggaaattttcaggaacgatattcataaatgagttttccaagttgcttgctctctctctttccttggggatgccagtgaattgtagatttggtatatttatataattccatatttcttggagattttgttcattaaagaatatctttttctttatctgactgagttgatttgaagaactggccttcaagttctaaaattgttttcagtttgatctgttctgctgttaatactgcccattgtattatgaaattcttgtagtgagtttttcagctctaggagatcagtttctcttcttttctttccttttttcttttctctcttctcttctcttcttttctctcagagtctcactcggttgcccaggctggagtgcagtggcaagatatcggctcactgcaagctccgcctcccgggttaatgccattctcctgcctcagcctcctgagtagctgggattacaggggcccgccaccatgccccccggctaatttttttgtatttttaatagagacggggtttcaccgtgttagccaggatggtttcgatctcctgacctcgtgatctacccaccttcggcctcccaaagtgctgggattacaggcgtgagccaccgcgcccgaccctgattctttcttaaaatggcaatttcatctttcagctcttgtgttattttattgatgccataagttccttagactgtgtttcaactttcccctgaatcttgatgatcttcattgacatctgtattctgaattccatgtctgtcatttcagtctggttatgaaccattgctggggagctagttcagtcatttggaggtaagaagacactcttgcttttagagttaccagagttcttgcattggttctttctcatctgtgtgtgtgaagttgttgtcctttgtatggagctttttacttttatattctttgatgccttttgtggtttgattgtggtattagttgtgcttagttaatttcattcgtttttggatgatttcaggggtccaagggttagctcagcactcctgggctgcatgctgtaccaggctgtaaccttgggaaattgggaccaggtctgaggcggttttctctagcccctagaggttaagtacctcctgggttggaaggaatgaggtgttcctggtccactggcaacaaaactgtgctggcaaaggcactttggcggggtggcagtgggtcagtgagggtccttgtgctcacatacgtgctggtggtggggtagtggcaagtcctgcacaggcatgcgtgctggtggtggggcagtgatggggtcagtgtgcatgcatacaccagtgagtcagtggctggaggctgcaggcaaaggcatgacagcaaagcagcaggtagaggctgccagtgagtgcatgctggtgggcgctcactgacagggacctgccttcaggagctctccagctgttaggcagggtctgccatcaaaatagcaatggctgtggctgtcaaaaaatgccttggctgggcagctgaggcagtgctgcaagtttgtgtagccaggcagggaatttggcataggccagcagacaagcgagtgcttggatcagattgttcccatcccacaagcaagagagccctgtgatgtccaggtctgtccatcaacaaaggcgaaagccacctagagatgtatgatatttgggggatgggcacccatgccatgctctgctgtagccattctcatgccaaaccctgtggactctgtgcaggctagaattctgtctctttcaactctccaggctgttctccctgccaccttaactgtccatgggggatgaggggtctcctgcagctaagattctggaggtctgtggtgtgagttggccactccatgaccatttaacttactccttccccaggagcctctccaggccaggaacaagttctggtgcttggcaaccctgtgcagggttaccagcttccttccctttcagcctggggtctgcattctccttccatcaactctcaatgccttctttctgaaaatttgttcagagtgtgccagtcttcttgatggtctggtccctcactgggagaaggtcttcttgtctgcgtctggtcggccattttgttttagtatttattaaataatgaaataataataatttgaaaaaattaaattattattatttaaaactctagatcttatttaaattttctatttaaccatgcctcagcagacattgtgatgcagagggagggggatgtatgaaggaattgcctcatttcccactcagcttcctttgatgctcaggtgagggactaatgctcattactactgcatggaggttaggcctcttctgataacactctggctgaaggtactttgttactgctccccttttggcctccactgacatcatggggtagtgatttcattactgcttcgcagtggtgaaagacttgacttcccactacctctcctcagacatggttctagtagatggggagagttattcctcattactgggtggtagttcatgcttcccactcagcatattcttttttttttttttttttttttttttttgaggtggagtctcgcttgttgcccaggctggagtgcagtggtgccatcttggctcactgcaacctctgcctcctaggttccagcaattctcctgcctcagcctcctgagtagctgagattaaaggcatgtgccacgacacctgactaatttttgtatttttagtagagacggcgttttgccatgtttgctaggctggtctgaaactcctgatttcaggtcatccacctgcttcagccttccaacgtgctgggattacgagtgtgagccactgcacctggtgcctattcagcatattctgacaccaatctagtagggaattgggccttcttacagcctggtaagcatggaagtcttttcagttgggatttattgtcttcctggatttgctgttttcccaagttgtcctcttattgattattttactagggagagcaggattttcttggagccttttaaaaaacttgcacttgttggcaggttgccaggttgctggcttcttccaagtccatgatatatgaagcaaaaaaaaaaaaaaaaaaaaaaaaaaaattgagagagctcactcttgtatcattccttttgtcctgcatttctgagcccacctgtcgtcttctctctaattttcagagtctttttatgtttgttttatttgtaatgcccaggtatttttttgtttgttttagccatatttagctggggaaaaaagaataagtaagtctgtcccatattggtctggagcgtttacatatttttgaagccgggttttgttttccagtgtttggctattgccaccaattttgtgcctttggtggatacaaaaattttgacctctatgtcttcatgtgcatcactcacaaaatcatggagggggccaataactggttccttctgtgtgtcactaaatgctttcataattttcattttgtgatttgacagaatttttgtttaatgtgctttctaagccctatagttctcttcagaattccatgttactctgtgtgctttctaatctgtattcataaaatggtaccattaatttctaagatttttttttacaatttttaatgttattcctttcatgctttcgcatgaacactatctgtattgccttcatttgctccacctcatttaattccctgttggcatcactatagttctttcccaacttttacctttgggttagtcgttttagcaatgttcagtttgctacattaaattcttttattcagttgacctttgtttatactctggcaaatgcccaagtttagactcacttcattttgtttctttttctgtgtttcctaattgctcctggaggaacacacggaacaaagtagattggtcccattaccacacactactaaaaattccttcctaacaattgaaattgattctgtaattcaatctcctgaaatgaattcaacttaaaagatgacttgaaaatatacttgatccttgttatttgcagattccatatttgcaaattcacctactcactaaaatttatttgtaacccccaaatcaatactcaaggcacttttatgatcattcacaagcatgcacagagtggcaaaatatcttattactcaatgagcatattcttacctgaggttgaaaaatgtgatactgtgcctttttgtttcagttctcattctgtaaacaagtgtcttttcttggtctacatagtgctacatttttcacatttttattatctttgctggcgattttgctgtttaaaatagtccccaactgtagtgccaaagtatagtgcaagaaggttgtgatgtgccatatggagaaaatatgtatatttggtaagctttgtttagttataagttttagcggtgtttactgtgagtttaatgttaatgaatcaacaatgtatattaaatagaacgtctttaaacagaaacacacacgaaatctgtttatgtcttgagcagttgacaaaaatgtgaccagagtctcctggaaaaccaaccctgtatttctcctaagaacaaggactcaacagtcattaattcagcatttgtggtgacttcacagaacacgactaccatgaataatgagaataacctgtattttatttgtcttcttgacggtcatggaatcattgatggtttagatattatgctagaccttcttttgtcctaatcatcatcatcctacttgcctccaactttcctgaaactgttgaaaacatcgtgcacttttacatttatgatcatccattattttctttattcaactatctcggtttctatagtctctatagtaatgtccttcctaaaaatttcagagaaacagatgtatgccctcttaatcttttattttataatttttattataaaaatttcaatggtatgcaaaaatagggaggataaaataatgaactttcatgtactcatcacctagttcaaaaatttacaactcatggccaaccttacgttatccgtacataccctgataaaatcccctcatcccctttccctaccaaaatatcaaatctattttgaagttaatcccagatgttatatactttcatctgaaaatgtccccattcaaaaatactattttgatggtgatattagaggtacacgctttacaaactttgtgagctacagaagagaagccaaatttgccctatgattacaatattctactttcttatctctgggaagacatggcacccatttttttgggggggagggatggagtttcatgcttgttacccaggctggagtgcagtggtgtgatctcggctcactgcaacctccaccttctggatttaagctattctctcgcctcagcctcctgagtagctgagattacaggcaaccgccaccacaccagactaatttttgtatttttagtagagacaaggtttcaccatgttggtgaaaaattccttcctagcttccaggctggtctcaagctcctgacctcaggagatctacctgcctcagcttcccaaggtgctgggattacaggtgtaagccatcttgcccagcctccatttaaaaaatgttcatgtctagcatccacagtttttaccacttgccttgctctttatattttaatatcacaaaaaccactaataacctcatatgtaaaaatttttccttgaatctcctactgtttctcatctcagtggtatttggcgaccttgcctttcttaagacatatcccttgtttgaatttcataattctgaaatttgctgatttctttcctcctcctccatctactcatttctggctgtatcctttgattaatctttctctctctctctcaatctggctatgctcaagattcagatctcagataaagtttttatctgctgtctatattctcactcaaagaagccatcttttctttgaactcagctatcaccttaatgagtgccaaacctgtgtctccagaattcaactcttgcccatatttagtcttacatttctacctacttcaaagtgatttctatttatatattttaagttcttaataggaaatgaaaatttgtatatgtgccatttgaaactcaacaggcatcatgaaatgttgcctgggtttttaagtttctcgctcatattattagggttcactattagagttttttttactcttatgtttcctccacatgtattcagttaagtcctagactattttcccactttaccatatcttttatgtttatttcttatgcccctattatttctgttaacaccctaatctattccctcatttctttgtgtcttaatacttccacggcttcctgtttggcttcttccaattttagaagtttctgaatacacttcctgttctgtttctcactaaaccattcactaaaaataacaggattaatgagacaaatagagatagagacagactggtccctcaaaagctatgcaactttataactgaagaattaacaaatataataattggtacctttaaaaatagcttgcacagtgtaggcaggcaaaacgcccaaggtctggtggcttactcagggcatgttaaaaatgcaaagaaaaataatgtggaaacacaggtttgctggtgctaaggcaatatacacagggaagtgtagtcctgagcagaagaggaaatgcaacctaaaactgatacaaagctaggatacatctctctggggagggagttttgggtacaggcactcaggcattttcttaaaacagtgccccaaatgtgtctgcctgtgtaatagctgagttgaaagggttttccttttcttctgaagtttataattccactcccattattctggctcccttgcctaaaaaaaagcatatctaaaccatcataatttccatcttctactgacataactctgccattcactaatcaaatgtgagctaattagtgctggtagaatagactctatatttttttctatttgatacttgctggacatcaccttacttttcagcttgtaatgctatttactgctatttatatactattatttatattatttactatttgtatactgctatctctttaaaataattatttattctcggactcatttattcctgtctcttatgctgattaaagctttgttttctcttgtatcttctatttctctatcctgattttctctgcctgcatatagacttgggattttattatcaaaattatttatttttgaatagcttcatatggcatatcttatttctataagcagattgcaggtttctagaggacaagatccatgtgtttataatactctttttatatctcctcctacatacgagggtatcagtaaatgcttattggttagttgatttaaaatcacaaatgtattatttcaaatgtactattatattagttaattttttaaatggacaaaagaaaattcacaaggaagttagcataacgtagggaaaaaagcatgggcttctgaattagatcgctctggattcaaattcggggtctgccactgattagcacgtgatctcaggcaaattacttaatgtttctgagtttcagttttcttagtaacccagaaaaaattaacctagttctatgttttttgtaaacaagaattacatgaattaatgagataatattttaatcaattaagaacttcatagagtgagtatgaatacttaatgggtggtcaataattagaagcgccaggatcttgaggaataatcagccagtacctcattattacaagccatataaagaatcaaaactctggagtttgcaggatataaataatgagaatttgtgattttatatatgcatttcctaagttctgccttttgctagactaagcactttacattcactgtcttacatcatcttcatagcactcatcacaggtaggtattattaggagcatttacagataaataaattaaaggtcttagccagcatggaaaggccaaacttgagatagaaaccctggtgtctgactctaatgtctgtttttttttgtttgtttgtttttttaaaatcagtaatagactcttcactcccttttttggggggttatgttacactaataaagagtatagacaaaataattagggagttattttgtcagatgtgtcacataagttaagagtacagttcttcaaagagatggaggcttcaatctcattgttttgaaggtttcaaggtatttcaaggtttcaaggtttcaatctcatcagttttcaaggtattggaggtcctcttttaggtggataactgacatagatggagaaaatcacttatgcatgcgaacacacggaatacttttgaaaattacccctttcattacattcttaagttagaaaaatagccaattcctctgtaatgaactgaattatgaattactaatttctgtcttctcctttagggtgactctggaggaccactggttagttcagatgctagagatatctggtaccttgctggaatagtgagctggggagatgaatgtgcgaaacccaacaagcctggtgtttatactagagttacggccttgcgggactggattacttcaaaaactggtatctaagagagaaaagcctcatggaacagataacatttttttttgttttttgggtgtggaggccatttttagagatacagaattggagaagacttgcaaaacagctagatttgactgatctcaataaactgtttgcttgatgcatgtattttcttcccagctctgttccgcacataagcatcctgcttctgccagatcaactctgtcatctgtgagcaatagttgaaactttatgtacatagagaaatagataatacaatattacattacagcctgtattcatttgttctctagaagttttgtcagaattttgacttgttgacataaatttgtaatgcatatatacaatttgaagcactccttttcttcagttcctcagctcctctcatttcagcaaatatccattttcaaggtgcagaacaaggagtgaaagaaaatataagaagaaaaaaatcccctacattttattggcacagaaaagtattaggtgtttttcttagtggaatattagaaatgatcatattcattatgaaaggtcaagcaaagacagcagaataccaatcacttcatcatttaggaagtatgggaactaagttaaggaaatccagaaagaagccaagatatatccttattttcatttccaaacaactactatgataaatgtgaagaagattctgtttttttgtgacctataataattatacaaacttcatgcaatgtacttgttctaagcaaattaaagcaaatatttatttaacattgttactgaggatgtcaacatataacaataaaatataaatcacccatttgcttgacattatgatatgataatccacaaagaaggggaagatgggaaaaatgttactagtcaatttattgtaaatttttttaaaatttgaggctaggatgaaaattaatttaataacaatcagcatgcttatgtactaaaataattgcgttgtggaatgggagggaacgaagagttcaaacaattgactggaaaggttttattcgtctaagactttcccaaacagcaaatccttgaagggaatgagatccaggtgttagtgtacagtctagtgatgcaactgaactggggctcagacctctattttgagatgattgtagatatttttcttcccctgctgctgtgtttacagttcatacatggttaatggtcctgttagactcctcttcgctgagatggaaagataccatagagaaaatatcctggaagctgcctcactgctgcatctagtgtgacactgaatggctaactgcctggataacaaaactgaagagtaaaagcatgatattggccaccttcatgatttttagttttggtaaattattactgagctgttagagacacagctttcaagtaatccagaccgtaatgaagttaggactggtaccatgatgtacggcatgttaatggtgagatttcaccaagtctgtcctcattgcatatagctactcatataagttctatattgtacaataattaccctgaaaaccagtattgccacgaaaaatttaagtttattgatctgaataacactggagtatgaactgataacatttaggcacttggcaaaaatatgaaaactgacatgaattgatagtgctaaatattttgcataagctatttttgtttcatttagcaaaatgctctgggaaaaaacaaaattgaggaaaaccttgaattttaagcaaggatataagtacctttaaaactactctcagtgttctgttaaaaatggattcctcttgtttcagtgtattctgtagttgggcctctaggtggcacccacaagctgtaggaagctatggggaagcctgacatcaagaaggatgtctagatctgtaagtaataatgagaactgtacctgaaattagagtctcgtgaaaccaaaagaatacagtttttctttgcaaatggcgtttaaaaattaattcgtgttgatttacatcattattcgtatttttcaaatttctggacatttgattccaaactaaaataaaatttatgttgcatgatttgaggaactccctctgcaaaagcacctggagcaatttaaattaagaagaaattttaaaagcttaattttgcaatgacatcttattcctaagagaaatacttttgatatttccttctacaaaggatttgagaaatagaagtttgggtcaaagtgaaaatatgagcgatagttcaaactttatgtacatagagaaataggtaatacatttctaaaatggtaacttcttttgaaaagtaattaccaaagggttttatctgcatgtctgtgttaactgtttcattggagatagttaagaagatgtgacgataatatttattacttttttcaagagggcaggcagttcctcttctatatcttcgatctctcttcctacagcactagtaaagtactctgtatataacagtccttcaataaatgttgttgaatgactcttttatttttacattatgcagaaaacatagctttattattatttacacattgatttttaaaattaatcccagattttacactgagtgaattaagccggttactatttatctaagcctataatctcacccgtaagatagagatgatatttgctcaaatgattgttgtggaaataaaactgtgaatgtttaaaaagtgcttagcacagttcttggaacattagtaggtgttcaagagaccatagtaataataactgttgctataatgaaactacactcttgttttaaaaaatatggtatttgattataacaggctgaataccttttttttttgaaatgacaagataattagaccaacaaaatgtgctagttaaaaaaatttctgattctacaaaaagttttactgggataattccgaaacatatttatcaaagtggtctgtcaatgtgagggttcattctaacttttgacttcaattttaaaaaatgataaactttattaaccaccgagtggctggattatatcaagatctatggtgtagttcaaatgtcgcctcttccctgaagcctttttttacttcctcaagtggatgtactatacgtttcttctgaacttccttaccattaattttttttattttcagataatcattgattcagatacggttaagatataactgtaagatataattcacagagattctgtgtaccctttactcagtttacctcaatagtaagatcttgcttaggtgtagtataatattacaatgaagaagttgacattgagacaatccattaactttattaggatgcaatcaattatatatgtgtgtgtaggtgtgtgtgtaattagttctatgtaatttaattacatatgtagattcatgtgattaccaagatacagatagtttgttcacaaggctacatcacgctaccgacagccatccagctccctccctaggcctgtgtctagtctctaatccctggcaaccactaatctgctctccatctttataatttttattgtttcaagaatggtatataaatatattatacaataagtaactttttcaggttggctttttcgctcagtataattttcttgagatctgtccaagttgttgtgtgtgtcagtagttaattctttttttattactgagtagtattacatgatagggctgtacctcagtttgttaactgtatacccactgaagggcatttggattgttctcaggttttggctattacaaataaagctgctatgaagatttgtgtgtaagcttttgtgtggacataagttttatttttctgagatttatggcctagagtatgctgggtcatacggtaagtacatgtttagatttttaagaaacggccatattcttttcacatggctccttactacttgtaaaactctctgtacttagaatatctacctgtgtatttcagatgtgcagatagatgtgatttcaacaactagactgtaaactccatgagggtggggacagtaactggttcatttttatatccttcacagttcacaggaaactataatattgtttatggcagttgttctataaagatttattaaataaaaataaagagtaataaaagcaaacaaataaatatacatgaaataaaaaagaagaaatggctttgggtagaaaagaatgaacagtatttccttcatgaaggtattactgctcaatttctgtaattctgcatggactctaccatggcacttccatgtatcttatgttggttgatataaagtctgtttttcacctttccacagggtacacaatcaaacatagactaaagacatggttgatatggagaatctctctttatatctgaatttagtttctgatacatgttatatttaagagttttctgacacatctgtatcagcttctactgtatttgtggaatggattccagtttaggagcacaatcaataaatatttgttgctcttactttttataactatgattctataatttgtcctaatgtaatttttattatataactcaaggtggagtgaaagacagagacctgtgaaatgtaatcagaagttctctcttaattgtccctaacacaataatcagtacctctttggcgtagatgtagtcagcttaaattttacaatcacagtactcactgccttgcatatacccctcacctgcttgttctcttgctccaccactctgtgacacttgctttttactatgatcctggtaaaatttaactctccacttactgtttttaaaaactaattaatttcccccaattttattaaagtataattggctaataaaaattgtatatagttacagtgtaaaatttgatgttttgatatatgtatacattgtgaaattatttaatcaagctaattaatatattcattacctcaatacttactattttttaaaagaacatttaatatctattcagcaatatctacttttaacaatttaaaaatactcaatacattattattaactgtagtctccatgctgtaaataggcctccagaacttatttcttctatataactgaaactttgtaccttttaatcaatatcttctcatttctaccacactccagcctctagcaaccaccattttactctctgcttctattagttcagctttcttagattccacatataagtgagatcatgtagtaatcagcactctgtgtttggcttatttcacttaacataatatcctccagattcatctatgttgtcacaaatgacacgattcccttcgtttttaaagctgtatcatattccaatgtgtgtatttctttattcttccaccaatggacatgtaggttgattctatattttggctattgtgaataatgctacaataaacatgagaatgcaagtatttctgtaccaaaagtgaaaaacagaatggttgtatggtacttaaagtatggtttctactgaatatttcaattaatcactgctgagataaccaaaatagtgtgtaaaaaacaagcaaatcagcaaaaccaaaattgcactttttcaaaatgtcagataaatgactaatcttttaactagactgaactcccataaaggagatgattcacattttaataataaagtcagatataatagtaaagacattattaccaatcatacagaaataaaagaattataattgtatattaggagcactggtatgtcaacaaattataataacttagatgaaatgaacaaatctctaaaagacacagtcatacagactcaagagttctaacacaattccattatgttcaaaggacacacttcgtatgatttcagtacttttattgagagacacggcctagcaatggcctatcttggaaaatgttaatgtacttgagaatattatatacagtcatgcattgcttaacaacagggatatatgaactgcattgttacatgattttgttgtgtgaacatcatacagtgtacttacataaatctacagggtgtagcctactacacacctaggctgtatggcataatctattgctcctaacttacaacctgtacagcatattactatactgaatactacagggaattgtaacacagtgggaagcatttgtgtatttaaacataactatacgtagaaaagttactgtacaaatacaatcatctaaaaaattaaaaaatggtatacctgttaaaattcttatcatgaatggagttttcagggctagaagttgctctgggtgagtcagtgagtgagtggtgaatgaatgtgaaggcataggacattattatacactaccgtagactttataaacaccatgcacttaggctacactaaatttgtaaacaattttccctcttcaatgaaaaattaactttagcttactgtaacccttttaatttataaactttaaatttcttttactttttgactcttttataatagcacttagcttaaaaacaaacatatttttcagccatacaaaaatattttttctttatacccttattctataagctttttaaaatattttaataatttattattttttacctttaaactttttggttaaaaactaagagcccaccacagctcagcaaggccactgtggccagactgactctctagattccctcctctctgggcagaacatctctgaaaaaaaggcagcagccccagtcagggacttatagataaaacccccacctcctgggacagagcagctgggggaaggggtggttgtgggcacagcttcagcagacttaaatgttcctacctggcagctctgaagacagcagtggatctcccagcacagcgttcaagctctgataagggacagcctgcctcctcaagtgggtcactgacccccgtgtatcctgactgggagacacctcccagtagaggccgacagacacctcatacaggagagctctggctgacatctggtgggtgctcctctgggacaaagcttccagaggaaggaacaagcagcaatttttgctgttctgtagcctccgctagtgatagccaggcaaacaggttctggagtggacctccagcaaactccagcagacctgcagcagagggccctgaatgttagagggaaaactaacaaacagaaaggaatagtatcgacatcaacaaaaaggatgtccactcagagaccccatcggaaagtcactgacttcaaagaccaaaggtagataaatccacgaagatggggagaaacaagtgcaaaaaggctgaaaatccaaaaaccagaatgcctcctctcctccaaaggatcacaactcctcaccagcaagggaacaaaatgggatggagaatgagtttgatgaattgacagaagtaggcttcagaaggtgggtaataacaaactcctccgagctaaaggagcatgttctaacccaatgcaaggaagctaagaaccttgaaaaaaggttagatgaattgctaactagaataaacagtttagagaagagcataaatgacctgatagagctgaaaaacacagcaggagaacttcatgaagcatacgcaagtatcaatagctgaaccaatcaagcagaagaaaggatatcagagattgaagatcaactcaatgaaataaagcaagaagacaagattagagcaaaaagagtgaaaagaaaagaacaaagcatccaagaaatataggactatgtgaaaagaccaaatctatgtgtgattggtgtacctgaaagtgatggagagaatggaaccaagttggaaaacactcttcaggatattatccaggagaactttcccaacctagcaaggcaggccaacattcaaattcaggaaatacagagatcaccacaaagatattcctggagaagagcaaccccaagacacataattgtcagattcaccaaggttgaagtgaaggaaaaaaatgttaagggcagccagagagaaacgttgggttacccacaaagggaagccaatcagactaacagcagatctctctgcagaaaccctacaagccagaagagagtgggggccaatattcaacattcttaaaaaaattttcaacccagaatttcatatccagacaaactaagtttcctaagcgaaggagaaataaaatcctttacagaaaaggaaatactgagagatttttgtcaccaccagtcctgccctacaggagctcctgcagtagtttctgctgccttttgttcagctatgacctgccaccagaggtggagtctacagaggtaggcagggctccttgagctgcagtgggctccacccagttcaagcttcctggctgctttgtttacctactcaagcctcagcaatggcgaatgcccctcccacagccagtctgccaccttgcagttctatctcagactgctgtgctagcagtgagcaaggctctgtgggcatgggacccgctgagccagggccgggatataatctcctggtgtgctgtttgctgagaccattggaaaaggtgggagtgtcccaattttcctggtagagtctgtcatggcttcccctggctaggaaatggaaatcccccaaccccttgcacttccagggtgaggtgatgccccaccctgcttcagcttgccttctgtgggctgcacccactgcccaaccagtcccagtaggatgaaccaggtacctcagttgaaaatgcagaaatcacccatcttctgcattgatcatgctgggagctgcagaccagagctgttcctatttggccatcttggttcttcactatagacatgttacaaaggaagatatacaagcagtcaacaagcatatgaacaaaaagatcaatatcactgatcattagggaaatgcaaattgaaaccacagtgagataccactgatcattagataaatgcaaatcaaaaccacagtgagatactatttcacacaagttagagtggctataattagtcaaaaaatagcagatactggtgaggttgcagagcaaagggaacacttatacactgttggtgggagcgtaaattagttcaaccattgtggaaagaggtgtggtgattactcaaaaagctaaaagcagaactaccatttgacccagcagtcctgttactggatatatgcccaaaggaatatatatcattctaccataaagacacatgtacatttatgttcattgcagcactgttcacaatagcaaagacatggaatcaacctaaatgcccatcaatggtagactggataaagaatatgtggtacatatacaccatgggatgctatgcagccataaaaaagaatgagatcatgtcctttgcaggaacatggatggaactggagaccatcatccttagcaaactaacacaggaacagaaaaccaaatgctgcatgtactcacttatgagggggagctaactgatgagaacacatggatgcaaagagacaacagacactggggtctacttgagggtggagggttggggagaagaataggatcagaaaaaataactattgggtcctaggctttgtacctgggtgatgaaatagtctgcacaacaaactcccatgacaggagatcacctatattagaagcctgcacttttacccctgaacctaaactataagtttttttttaaaaaaaatcttaagaaagaaacataaagtcaaacgttttgtgaatattatgtcaaaattatgtgcttatcattttgctgctgttccttttttaaaaatgctttttttatctctctgtaaaataatggtgttccctttctaatgcaaacatactttcagatcctaatcatcggggtaaacattctttttaaaactattgtttacaaaagtaaaaatctgactttgtccatgcagatcatctattgacaagtatttttcaacaacataattttaaccttatgacatcagttttaatagcagtcattacactattattccaggtgattctgggacacctgagtactctgtgtaattgaagttatctgtagccacatttaatatgacatgttcaatgtttggtctcacaagctcactgcttagagtcttcttcatccacccaatattgaagtaatgaaatggctgttaatagattcatcactgatctcattctgcgacatctttatcagaataatataaaatcaatgtaagaaatttggtgaaattatgaaaatttaggaaaaaataaatttcatttataaaatctgtgtgctttcattatggttttattctatttatataactcaaagtacatatattatgtttacataaaaattttttatctcattgcatgtatcttttcttctgacacaaaaattgtgatatttttctgttcatcattttgttccgtagtattcaacaatacctgtactatggctgacagtgtaatttaacattttttgataaaacaattgtaatgacatggtacacacattgtatacattttaaatcatttctcaatgtaaaatatttgaattgtctccagtgtttattttatgaatgtctgccacaaatattgaatctgaccatcgtgatttaggtgttctctgtatagtttcatatgagtatattatgaagccaatgtctatatgcatttttataatacttaatacttttccccaagtgtctgattcttttaaaatatgcaatcattatctgagaatctaatacataatggaaaagcaagaaaatttgtgacaaaaattattttatgtaagaaagaagtagaggacaggctgcacaactattgacctggattcgaacctaccttctgcaaatgaataacaacagctagtattagtatttatcactattgttctaatagtcattcttgcccttgtcttccttctccacctactctcttcccccttctaatggcaccatcactttcctctaatgtgaatgggaaaattttttgagaataaggttagagtgcatagaattttcattggtcttacctctgcctttgtcctttgggaaattaccacatagagcctatgcaattttcattcaacatagacattgagttttaactcaagtaagatttcagttttctgttgctgcttataagaaggtagacaaaaagatctcttaaggcttatataataaagtagtgaggaatgcttgctttctgcttatgtctcaaaagaataacattaaagtaaaatatatgaggttcttttgtttcttcgtaaggaagatcatcctatatcctgacagaattcttttgtaaatctcagtgtagttttcagatgcaagtggtagacattatttggatcttattatacatgcattgttcatttttttttggtgcttctctgtcaggcagctgtgatgatgagtcccaagtttcccagagatttttactgaggtgtcctataggcgtggcataaggcagaaaacattaaaaggttaaactgacccttttatgctctaagatataaacctctgtgatctcactgacgaaagttttaaatgctagagtgaaagcaagtaaacattggctttggctgagaatattctggtggcacacatttatgtcgttgatgaatagtgtaccttgaaaagccttaacccttacatcgttagcatttcatcttgttcatctgactgcccaaaaatctatatttaaacaagtccacaggggatctgttctctaggactttgctggagaaccttgatgtgttggaaaactgttcctattaatagaaaaattatatctcgagtggctggcatatgttaactaatggatactattaatagtaataacaaaaataaaaaatcattacaatattactactatttgaatcactatgtacgagagacattataagtgttttatctgtattaagtatattttcaacacaacacaataggaagaaattgccattattatagaagtaggcataattatctctatcaacattctagtccacttttccattatctgttgcataaactcatgcaaaatcttctaaatgatctacgcttttcacaatctggcctttttgtgatgtaatccattgacaacattgagagctttttaaagaaagggaatctgatcacatctctccatttcttaactctgtgcagtagctccccattgcccttaatagacacttcgatctccttataattatattgcttccacttacctctctagcaacatctgctactttactcagctttttcctgcatactaattagaaatcttaggaactgcctttacttcactacctgcttttctttttttgttttcctctccccctcttcttttcacctattcctgcacattactgaggactcactttaccaatgactttgagatctcttctagatgtttgcttagcattgtgaccttataacacttttagacttttcctttttacttgcttatagtctatctttcaaagtacaacgtaaggcatgagggagcagaaagtgcctacatttcttctctgaaaatcgagcacttatccatggtttatgctgatcacttcataaacattctttgaaggaatgacttatactttttttttactttgcacaatgaaggctttcattgaatcaaccctgttttcagagtctctttagtatccctctttgatatttaatgacactaaagtttacacagttgtgatgatatagaaacatatgagtttctaatggtaggtcactttactcgacctcccatattttctcttactgtgagtcaaacactctgaataaaaacatatctggccattccttctgaaatgcaaagcaaacaaatcaaacaggagtaaatttaccttaggcagggttttggctggtttacagtggagttcccccacaaaatcgacatttggtaagggtgggcaaagaaattcaaaatcccagtacgtttgaatgagccacacttcagctttccccattatctgaaataatgtacattaataaaataaatgtatacatatctttttatatataagcataacaattttcatatattgcatgttacttatatataaggaaagcaaagtgttcagataattaagaggaaattacatatttaatgtaacataagtatattcacaatcacaaatagttattgaaataagccactatggacttaaatatgcatttgtttcctctctaaagttgcagtagtaaccaatatagatttaaacagctctttgagctccacgattaattcatcttactatacttataaaaacagctttctacaaagcacaaaatctagtttccacaatttatcaagtcagtcccttgatccttggttctccaagtgaactgtgagttttctgagagtatggctgaaatccttgaacatactactgcttctagttcatgttaagattttaatgatattagttgtaaaatacatacatttaaaaatgatagctagtatatattcagaatttattgaaacagagatatgtgctcccccttaacttggcccatattttccctaataaagagaagtagttcaataaaatatagattaaaagcttgaatgttcactttcaacaaggtttcagttcacaaagcaaataatttccaagttgttagtgaactatgaacaaacactagaaacctcaaattttaggtttctgtttctgaaatagagccagtatacctctcaactgtgaaggaatccttctgtttatagagaaaaatattttaatacctaaataagaaaagtgaggtacacaaagagaaacaattttctcaatgctgcattaatagttatgctagaaatatgtgtagctcctcatctaaatgtctgccttcatcaagttgtttattgatatatgtattgccttttttaaagatgaaaaaagtatagtaaaatacttatatagttgcttaaagaaatcataagtgctttactttgtagttttttttttttaattcctgtagtgtcctataggagcgatggccaaagggttctagctgagcctataatatcaacatttctataatatttgtgagattgatagatcatcttacatttgccattcatcatttcatttaaacaacactatcttcttacattatatttatatacgctcaccttcaaaggcaaaaggaaagttagaacttattaaccattgattagaaacatgacttacctagaacttcactgtaaaacttctcccacttctcgtatcaaacatttgaaaccaaaagtcaaaataaagcacatgtattaaatttttaatcctctccacgaatgtcattttaccacttaattcagacagaacagcaggtatgcgggaagtggggaatagaagtcctccactatacttctcaagtgtgtagccaggagactgtcaacaaaggacatgtatttaacatgcctttaacatgctcagctagcagttcaccacaggcaccaagggcatctgcaagaacgacatcaaacattgactcttgtagttttgtcgtaattttcttgttcaaaactacatctttacagagattattaacacagtctgtagattcccaaaagagttcttgtgcttgtgagaaatatgaccaaaatgcatctttctgaagatcgtatatccatctattgatcagtttcacaacaagaccctcaaaattatttttaattagagatgttggataaacctcaaatctaatagcagatgatttactagggtgaataataatggaagccaaagatgacagcacagtcatcttatggcctctccaaacaagttcatccaggattgtctttatattcatccaatggctgtattctgtgggccacactagcacctttccacaactcccagaactaaagtgacaactgagttgtatcaggagaatatttgacatcgatttcatagttctcctggtgcaatgcaatgcttcttttcaaatcgctgtttctttctgtttttctcctacttatatctgaagataaatcaatcaagtgaaagtataactgctacaattcaaagtagtagttaccatataatttctaaattaccataggaattgtctgttaccatataatttctaaattaccataggaatttccagattgtttttcacagtggatgcttcaatttccattctcaccagcaatgtataagaattttaatttcttcccaaccttgccaacacttgggattatatttcgtttgattatagccagtgtgaatgaagtgatatctggttatgctttacctttctttgatatgaaatcatgttgagcatgttttgcctaattttggttgaattatttgtcttcttatggacttgtgtttttaatatctttctgatataagaaccttatcacatatatgatttccttgttttttttttattctttgggctgtccttttactttcttaacggtgttcattgaagcacaaaagtattgattttgatgaagtccaactaatcaattttaatttggttgcttttatttttgattttatatctcacaaaccatttccaagttacaaaaattagtacctgttatttattattagagttttatagttctagtgcttacatttaagtttttgatcacctttgaattagcttttgtaagtgatttgaggtagagggtcccaactcaattattttgtatatggataatcattattcccacttatatttgttgaataatctattctttcccccttaaatagttttgaaacttttgtcaaaaactttaaatgcatgggtgtatttctatattctaaaatccattccattgatctacatgtctatctgtaggcctgtatcacactctcttgattattgtatatttgtatttgtctttaaaagcaggaaatgtaagttttccagctcatttttattttaaattgtttcagttttttaaaaaatttttttcttcttgctttttttctttaagaggtagaggtgttactatattgcccagactagattcaaatttctgggctcaagcaatcctcccaacacagcctcttgagtagctggatttacagatgtgtttcactacacctagcttcttttggctattagtatgtctcttgaatatgtataaatttcagaatcagcttgtctgtttatgcaaagaagtgatctgggattttgatagggattgcattgatttggtatatgaatttggggagtagagtatggtaattatcacaatattaggtctttcaataaatgaagatgtgatgcctttctatttatttagatgttcttatttccacagcgttttgtagattttgttacagtggctagctagtcagacacaaacagggcagaagacggctcccacaccctaccaggaaagtcagatgaccatcagttaatggtcaggcagttgtcacactgtctcgctaaaataataattggttgcagccagccagagaaaggcagctttcctataaatagaaaaaatcaaatctggtaatcagcagcttcctgataagatctcaggagttgggtgagtgggctcacgcatgcacattaagaggccaaatggtggagtaagacattccggtggcaccagaaaagggaagaatgcctcaggggagcattcatatgactccagtaaacatactgtgcatactcatctcctaagtgctagcaggccatcacacataccagcaggtcaccctaaggaaagaatcaaggaaaatggaagcaggatcctggaagtatgccaacatataaaaccctaagtcaaaggtcaaacactgcactttaccttcaaaatggccacttggatataccccaagtgtactttcctttctttcctgctataaacctttttaataaattttcacttttgttctgaaacttgtcccggtctctttttttgccttgtgcccctcaatcaaattctttcttctgaggaggcaagaattcaggttgctgcagaaccacaaaaatttgctgcagtaaccaccactagtaataatttcacagtgagagttgtacaattttttgttaaacttattactaagaattatattttttcatggtattataagggtgattgtttaatcttcattttagtttaaatttccattgcaattttgtagattttttgttttcttatcttggatcccaaaatcttgttttattggtttacttgaatattttttagtggatttgtaaaaatttcctattacaagatcattatatatgccaatagagatagtttaacttctttctttctaatgtggattccttttatttcattttctttcttatttgttgactgaaatttctactgcaatattgagtggaagtgagaagagtcaatttagtgtgatgttagctgtgtattttttttttttttttttttttgagacggagtctcgctctgtcgcccaggccggactgcggactgcagtggcgcaatctcggcttccgcttcccgggttcacgccattttcctgcctcagcctcccgagtagcagctgtgtatttttttatagatactattgatcagttttaagatgttctcctttacttctagtttaagtgttcttatgatgaagagtattgaatttcattaaataagtttttctgcagttattgaagtgattatgcagttttttcctttattctaatgatatgatatactagttggctttttcagatgttaacataactttgcattcctggaataaaattcatttgtttatggcatttaagcttttcgtatgttcctgaattttctttgctagtgcgaaaggaaagtaaaaatcttgagacattaaactcactatgtcaaagagaaaagttaatcttgggaaacaaaccatgtaaaactggctcccattttgttcctaaacagataaatgcaaaaatagaaggccacatacctctccagagggcctccttcccaatttactcacaaggaaaatcacaaggtcctaaaacagagttctcttgacttttaccctgagagtataaattaacattttatatttgcaggtatataaaagacaggacttgaagccattgtgtggtttttagcataagggcttactgaatggtggttatgttttctcctcttttattttttggaggattaattattttaaatatttgatagaagtatagagctttgatattttctactctaccatttccagttattaccccactatttttttctaaataatatttcactggaagccatcagacactggcttttcttttatgggagactttttccttacagcttcaatcttgttacttgttattagtttgttcaggttttttatttcttcatgggtctatcttggttggttgtatgtgtccaggaatttattaatatcatctaggttttccaatttgttggtatatagttgttcataatattctgtaataatttgtgtttctgtaatctcagttttttgtctcctctttcacttctgattttatttagtgggtctgttctcactttttccaacttagtctagctaacagtttgttgattttgtttacttttacagagtttaccttattgtctgtggctgcttttgtactacagtggaagagttgagtaggaacaagagtctaaagggtttgcaaattccaaaaatatttaccatctgaggctttatagaacctattctgatctctgcaggttcattttttcctttaacctttctatatattcaatatatatttctatatatttctgtattactatatattcaatatattctatatattcaatgcaattttaataaaatagtatagatttttagtgagtcagatgatttatgtttaattatgttaataatgagttaataaattaatttgtatttccattttatttagaataggtgagtttgtttgttatgtggaatggtgcttctgttttaccttttttttgagaaatctctaaactgctttccacagtaattcaactaatttgcaatccaccaacagtatataagcatttccttttctctggatcctcactagcatgtggtattattattaatttatactttttagtaatagccattatgactagtgtgagatggtctcattgtggttttgatttgcatttctatgatgattagtgatgttgagcatttttgtcacgtttgttggttccttgtatgtcttcttttgagaagtacctgttcacatcttttgcccggtttttcacggggttacttgatttttgcttgttgaattattcaagtttcttatagattctagatattagacctttaacagatgtgtagtttgctaatatttcttcagtttacatctcacttgtgaattttgagttttgttgcaattgttattaaggacttagttataaattctttcccaaggctgatgtctagaatggtatttcctagattttcttcaataagtcttatagctttaggtcttatatttaaacatttaattcatcttgggttaatttttgcttggtgaaaagtagagatccagtttcattctttttcttatggctagcaagctatcccaccatcatttattgaatagggagtccttttctccattgcttatttttgttgactcagtgatagatgactataggtctgttgctgtatttctgggctctgtattctgtttcattgatttatgtgtctgtttttgtaacagaaccatgctgttttggtgtctgcagccttataacatagtttgaagttgggtaatgtgatgcctctggctttgttctctttgctgaggcattcttcagctatttggactaatttttggttttatggaaatttttgaatatttttttctaattctgtgaataatgacattggcattttaataggaatagcatttaatgtgtggatggctttggttaggatggttattttaatgatattgattcttccaaccctgagcataaaatgctctaccatttgtttgagtcatctatgatttatttcagcagtgctttgtagttcttgtagaaaacttttgtctccttggttagatgtatttttaagtatattttgtttgtgtgtgtggtataaatgtgattgtgttcttgatttgactcttagcctgaatttttattggtgtatagaaatggtattgatttttgtacatggattttgtatcttgaaacattactgaagtcatttttcagttctagcaggctttaggcagtctttaggattttctaggtatagaatcatatcatcaccaaagaacaataccttcaattcttttcctatttggatgccttttatagctttctcttgcttaggtgctcaattaatacattattgaaatagaaagtgctgtcattttaatcatttatatttgaaatataaaattttaaaaatttatatttgaaattttaatcatttatatttgaaacataaaattttaaaattttaaaattttaaaagatttggactatgttaagtccaaattcattgcagaaatgtacttatccatttaataataataatagttatagcaaattgaattttgctatatacagcaattacatacagcaactcttttagtctcagcaatgctattaagtaggtagtgacattgcttcatctacatttcactgaaggagaatgtgaggcatagacctgataagtaatttgcttaactatacatgattctgtaatggttttgcaaagatgatataggttatctggattcagagtgcaagctcttacccaccatcctatgctgactactctttctgggttacaggtagttacaaaatgtaatatagattcactttttttgtaggtatatattaattttaatattattacaggagtataactcaaatatgtaaaaatatttttctggttgtctatcactgcttaaccaactgctctgaaatgaaggtgcttagaacagcaacattttatcatcatctgttttaattctaggttgttggccaggctcaattaggtgtttatggcacagcatttctcagttggttactgtcctaaggtagcttgggctaatcatctgaaggttaatcactcacatatctggtgattagtattaaaagtctcaagctactgcagtgctgggccaattgtgacttattaggcatacatatgtatttctacaccaaatggtatatttctcctggggactgtggatatagcacagggctccaaagcgagtggagagacagagaaaaaggaaaaaagaatgacagaaacacagagaaaaggacagaaggacagacagagaaaatgtattaacaatttttttgagctttggaagttaagctcctcacttccactatattctcttttttgagacagccacaaaatttgctaaatttcacaggaagggtatatgacttgatgagaggattgccaatgcatttgtaatcacatctcaaaattactgcaaatataaccttaaaaattagaagaaatcactaaactactgtagaattcataaaatgttgacataagacattaaaattttaaaaatttgtttgctaaaattttagccataattaaaaattttaattaacattctaatatatttattaataaatatttaaaatatcaagtaggtgtccaaaaacaggctgtaaatttatcagatagagagcaccggattgctggtcaatttaagttttctaaatggcactaatggattgataatattatattaaaacccaagaacatgctatctcaaatcaatgtttatttcactaattaatttttaaaactatataattaatatataaaaacaaatttgtgaaaggttagtgaatgaagtatatagaatcaaaattaaaagtagaatcctctatgtttatacagatttacagattcttaattttatttcaaagaagaatatcatacttttttttctggaactttttttcatttagcaatgtgatgtggagagcattccatgatattgtctgtaatatgcctgttctctgtaattgctgcataccttctactttttgtggtaggtatgtatgttcattgactgatagccaggcaagtgatggagggaacatcctgtacatacatgcactcaggtgcaagtatatctggatggcagatgactagatgtagaattgcagagtcaaactgtatgtttaattttttttgtaagagttgtttcactttatactctctcacaaactcttttctcagattcttatgtttgatcaatctcctgtgggaaaataattcgttgactttttatggctacatagtaatccatggtgtatacatactgcactttccttattcagtctaccattgatggacatttaggttgatttcatgtctttgctattgtgaatagtgttgcaatcaacatatacatgcatgtgtctttataatagaatgattatattcctttgggtatatacccagcaatggcattgctgggtcaaatggtatttctgtcattaggtcttggaacagacaaccaaatgctgcatgttctcacttacaagtggaagctaaatgatgagaacacatggccacacaggaagctaagtgatgagagcacatggaacacatgaacaacacacactggggcctcttggagggtagaaggtgggaggggggagaggatcaggaaaaataattagtgggtactaggcttaatacctgggtgttgacacatatttacctatgtaacaaacttgcacatgtacccctgagcttaaaataaaagttaaaataaattcattgacttaaggttattgacttactaaattataatgtccaactttctagtacaagtagccatctttttgatgtgattggccatttttacttctgtgaattgtcaattcatatccttcatctattttcatattggtctgtttgtctttttggttggtgatatataatagctctcactatacaagagataccagtcctttatctatgtgttgcaggataagcttgatgtaaattactttaggtttgtatgcatgatttagcaatattatctactatgacactatattcattcaatttttcttaaaaatgtttcatttatctagatacattttataaaaatgttgctgcaatctcttccaataattcccttagcatcaaaattttaatttatttttagaatacattcatgccataggtcatagagtggttattgtgagacttggatgatggtcttcttaccaataaagacacataggtttgtgttaacccatactactttgatcataaagtgtttccttgatgtgtagcttttaagagggccttgagaattcctgagattttattatttgccaatttttggtaatttttgtggtcttttaattgttactgattatgattagttgcaatatgcttacattttaaaaaatcattatcctatttttggtcatgctaaatgacttatgttttcatattagtgttatgggatgaatagagttacaggcttctgaggaaagagagaaacatgagacatccttatataaaatagggttatatagaataattatcatttttaactgtcttctacaaacacattcagtttcacaaacatctgtaaggcagctcaataattctgtgccttgttttggaagaagtgaacacatatatacatgtacatttgtgataatcaaaatcagtaagtccccttaaagtgctggttttatattatcacaacctacaattcagacattttatccaatattaaagtttaaaaatgaccgtgaaagcaaccagttcacactttagaaaagttcatggggaaaagagaattagcttgtgaacaaaggttttcccaaatagttaaattttgtagtatttgtcaggtaggagtcattctatctctaatttgttgttctccaactccaagtctctgagtcccattattttgctcttcaggccctgaatttggcataaagtgtagtagaggcggacagtgtcgtctcctgtgcatcactgttgctttgcgaagaaattctcaatgtggtcagctgctgctgctacagaagtcgattttctttaaacactgccaagaacatctgacttacatagtatattttgatttgatatttattcaaactgagcctgctttttttctttttacaaactctctaaaactgctaaaagtcttcactttataaactatgtaattaccatgatctttatactgttggtaaagcaatggttcactttccccatgtctttcacctcagttcttttctcccctgtgtgaattgtatccattttgttcaaagtgattttactgaataccaggagttatcacctctcaagtgttattggcaatgagattgtttttgccagttatcagtgaattattaaattccaaagtcccttgttgagggtctgctttttagtgccacttgcccaagctgccatagtctatttttctcagaaagcaaagcctgagataagaattagtgtgcaataacttaatttgagaaatgttcttagggtacaggagtaggggacaggaaagggtgaaacaagaagggagaaaagtcagtacaagaatgtgttaccaaactaatcatcaccataactgttgggactaaagctcatgcggacccagtaggaagttgtgtggatgtaaagcgtgatcattaaccatcactttctattgctcacactgccaggttatgcatatgtgagtgagtgctagctgagtttcttcgagggttccatgaagagatgttaaagaagtctggtgcagaaaatgagagacctgtcctatcagaagacgacttcacaaagctccttgacacagcaaaggctagagaaaaaaaaattagctgaaaaaatatggggtgcaacctaatttgatcaaatgtattagagctttcttttttcttttgtttcattttcacagtatattacttttcatatgattaaatactgtaaattttctcaggtttctgataaagttatgcctgtgatacaggagctagaaagaaattatttaggcagatagtgagggtgaaagtccttggtaaggttttgttttaataaaaagcagccccccaaatcatttccttgctaacaaaaagcagccagaaaaatcaagcttcaaacctagataaacaagctaaagcttgcataggtaaatgctggcaactgtgccagtaattcctcaaggatctagaactagaaataccatttgacccagcaatcccattacttggtacacgcccaaaggattctaaatcattctattataaagacacatgcacacgtatgtttattgcagcactattcgcagtagcaaagacttggaaccaacccaaatatccatcaatgttagactggataaagaaaatgtggcacatatacaccatggaatactacacagccataaaaaagataagttcatgtcctttgcagggacatggatgaagctggaaaccatcattttcagcaaactaacacaagaacagaacaccaaacaccacttgttctcactcataagtgggagttgaacagtgagatcacatggacacagggaggggaacatcacacactggggcctgttgaggtgtggtggactaggggagggataggattaggagaaatatctaatggaggtgacgggttgatgggtgcagcaaaccactgtttcacatgtatacccatgtaacaaaactgcagattctgcacatgtaccccagaacttaaagtataattaaaaaaaaaaaagaaagaaaagggatgggataccttgaagccaggtatattcaacatggatattcaacgtggaggtcccctctttccttttctttgtcaaccatatgtgcagtaaagaagcagcaacatggcactggccatgtagagaaaccatttgcttattgaaaattaaggtggggcagacagcttcttcttacactatgtaaatggcacacctggttccaccaatcctttgtgccctatataaatcagacactgtttcctcaagctcatctataaatccctgtgcatttcaccatgggactagaagatccattcgggagcacctttctgcagaaatgagagctattctcctttctctttctttcccctattaaacctccattcttaaactcacttctcgtgtgtccatgttttcagtttccctggagtgagatgatgagttttgagtatttaccccagacaatgatgctgcttaacctgttacttttatttattcttatttttaaaatttttatttattttttatttattttactttaagttctgtgatacatttacagaacgtgcaggtttgtggcataggtattcatgtgccattgtgatttgctgcacccatcgacctatcatctaggttttaagccctgcatgcattaggtatttgtcctaatgctttctgtccccttgtcccagaccccctgacaggccctgatatgtgattttcccctctctgtgtctatgtgttctcattgttcaactcccactaatgagcgagaacatgtagtgtttggttttctgttcctatgttagtttgctgagaatgatggtttctatccatatccctgcaaaggacatgaactcattttttatggctgcatagtattccatggtgtatatgtacacattttatttattcggcctatcattggtaggcatttgggttgtttccaagtctttgctattgtaaatagggctgcaataaacatacatgtgcatgtgtctttatattacaatgatttttaatcctttgggtatatatccagtaatgggattgctgggtcaaatggtatttctgcttctagatccttgagcaattgccaaaatgtcttccacaatggttgaactaatttgcactgccatcaacagtgtaaaagtgttcctatttctccaaatcctctccagcatctgttgtttcttgactttttaatgattgtcattctaattggcatgagaaggtatctcattgtggatttaatttgtatttctctaatgaccagtgatgatgagctttttttcatatgtttgttggccacgtaaatgtattcttttgagaagagtctgtttatagcctttgcccactttttgatggtgttgtttttgtcttatatatttaagttccttgtagattctagatattagacctttgtcagagggatagattgcaaaaaattcctccattctgtaggttgcctgttccctctgatgatagtttattttgctgtgcagaagctctttagtttaattagatctcatttgtcaattttggcttttgctgcaattgcttttggtgttttagtcctgaagtcttcgcctatccctatgtcttggtattgcctaggttttcttctagggttcttatggttttgggttttacatgtaagtctttaatccatcttgagttaatttttgtataaggtgtaagaaaggggatcagtttctgttttctgcatatagctagcaagttttcccagttttcccgttgcttgtttttgtcagttttgtcaaagatcagattgttgtagatgtgtggtgttatttctgaagcctctgttctgttccattggtctatatatctgtcttggtaccagtaccatgctgtttttgttactgtagctttgtagtacagtttgaagtcaggtagagtgatgcctccagccgcttttttttgttttgttttgttttgttttgcttggggttgccttggctatacaagctcttttttccttccatataaaatgtaaagtagtttttctagttgtgagaagaaagtcaatggtagcttgatttgaatagcattgaatctataaattacgttaagcaccgtggccattttcatgatattgattcttcctagctgtgagtatggaatattttttcatttgtttgtgtcctctcttatttccttgggcagtggtttatagttctccttgaagaaatccttcacgtctctttttagccatattcctaggtactttattctctttgtagtgcttgtgaatggaagttcaatcatgatttggctctcagtttgtctattatcagtgtataggaatacttgtgatttttgcccattgattttgtatttggagactttgctgaagttgcttatcagcttatgaaatttttgggctgagatgatggggttttccaaatatagaatcatgtcatttgcaaacagagacaacttgacgtcctctctttctatttccataccctttatttctttctcttgctgattgccctggctagaacttccaatacaatgttgaaaaggagtagtgagagagggcatccttgtcttgtgccggttttgaaagggaatgcttccagcttttttgcattcagtatgatatgggctatggatttgtcataaattgctcttattattttgagatatgttccatcaatacctagtgaattgggagtttttagcatgaaggtgtgttgaatttatcgaaggccttttctgcatctattgagataatcatgtggtatttgtgattggttctttttatgtgatggattatgttcattgagttctgtatgttgagccaggcttgcatcacggggatgaagctgacttgattgtggtggataagatttttgatgtgttgttagattcggtttgccagtattttattgaagatttttggatcaatgtccatcagggatattggcctgaaattttcttttttgttgtgtctctgccaggctttggtatcagcatgatgctggcctcataaaatgagttagggagaattccctctttttctgttgtttggaatagtttcagaaggaatggtaccagctcctctttgtacctctggtagaattcagctgtgaatccatctggtcctggactttttttggttggtaagctattgattattgccacaatttcagatcctgttattggtctattaagagattcaacttcttcctggtttaatcttgggagagtgtatgtgttgaggaattcatccatttcatctagattttctagattatttacatagacatgtttatagtattctctgatggtagtttgtatttctgtgggattggtggtgatatcctctttctcattttttatttcatctatttgattcttctctcttttcttctttattagtcttgttagccgtcgatcaattttgttgatcttttcaaaaaaacagctcctggattcattaattttttgaagggctttttgtgtctctatttcgttcagttctgctctgatcgtagttatttcttgccttctgttagcttttgaatgtgtttgctcttgcttttctagttcttttagttgttatgttagggtgtcaattttagatctttcctgctttctcttgtgggcatttagtgctataaatttccctctacacactgctttgaatgtgtcccagagattcttgtatgttgtgtctttgttctcattggtttcaaagaacatcttgatttctgccttcatttcattatttacccagtagtcattcaggagcaggttgtttagtttacatgtagttgagtggttttgagtgagtttcttaatcctgagttctagtttgattgcactgtggtctgagagactgtttattataatttctgttcttttacatttgctgaggagagctttacttccaagtatgtggtcaattttgtaataggtgtggtgtggtgctgaaaagaatgtatattctgttgatttggggtggagagttctgtagatgtctattacgtccgcttggtgcagagctgagttcaattcctggatatccttgttaactttctgtctcgttgatctgtctaatgttgacagtggtgtgttaacgtctcccattattattgtgtgggagtctaagtctctttgtaggtctctaaggacttgctttgtgaatctgggtgctcttgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggcagatcttcctccatccttttattttgagcctatgtgtgtctctgcatgtgagatgggtttcctgaatacagaacactgatgggtcttgactctttatccaatttgccagtctgtgtcttttaattggagtatttagtccatttacatttaaagttaatattgttatgtgtgaatttgatcctgtcattatgatattagctggttactttgctcattatttgatgcagtttcttcctagtcttgatgggctttacattttggcatgattttggagtggctggtaccagttgttcctttccatgtttagtgcttccttcaggagctcttttagggcaggcctggtgatgacaaaatctctgagcatttgcttgtctgtaaaggattttttttctccttcacttatgaagcttagtttggctggatatgaaattctgggttgaaaattcttttctttaagaatgttgaatattggcccccactctcttctggcttgtagagtttctgctgagagagctgctgttagtctgatgggcttctctttgtgggtaacccgacctttctctctggctgcccttaacatcttttccttcatttcaactttggtgaatctgataattatgtgtcttggaggtgctcttctcgaggagtatctttgtggcattcgctgtatttcctgaatctgaatgttggcctgccttgctaggttggggaagttctcctggataatatcctgcagagtgttttccaacttggttccattctccctgtcactttcaggtacactaatcagacgtagatttggtcttttcacatagtcccatatttcttggaggctttgttcatttccttttatacttttttctctaaacttcccttctcacttcgtttcattcatttgaccttccatcactgataccctttcttccagttgatcacatcggctcctgaggcttctgcattcttcacgtagttctcgagccttggctttcagctccatcagctcctttaagcacttctctgtattggttattctagttacacattcgtctaaatttttttcaaagttttcaacttctttgcctttggtttgaatttcctcttgtagcttggagtagtttgatcgtctgaagccttcttctctcaactcatcaaagtcattctccgtccagctttgttccattgctggtgaggaactgtgttcctttggaggagaagaggtgctctgctttttagagtttccagtttttctgctctgttttccccccatctttgtggttttaactacttttggtctttgatgatggtgatgtacagatgggtttttggtgtggatgtcctttctgtttgttagttttccttctaacagacaggactctctgctgcaggtctgttggaatttgctagaggtccactccagaccctgtttgcctgggtatcagcagtggtggctgcagaacagcagattttcgtgaaccgcgaatgctgctgtctgatcgttcctctggaagttttgtctcagaggagttcccggccttgtgaggtgtcagttctcccctactggggggtgcctcccagttaggctgctcaggggtcaggggtcagggacccacttgaggaggcagtctgcccattctcagatctccagctgcgtgctgggagaaccacttctctcttcaaagctgtcagacagggacatttaagtctgcagaggttactgctgtctctttgtttgtctgtgtcctgcccccagaggtggggccttcagaggcaggtaggccttcttgagctctggtgggctccacccagttcgagcttcctggctgctttgtttacctaagcaagcctgggcaatggcaagtgcccctcccccagccttgttgccatcttgcagtttgatctcagagtgctgtgctagcaatcagtgagactctgtgggtgtaggaccctccaagccaggtgcgggatataatctcctggtgcaccgttttttaagcccattggaaaagtgcagtattcaggtgggagtgacccaattttccaggtgccatctgtcacccctttctttgactaggaaagggaactccctgaccccttgcacttcctcagtgaggcaatgccttgccctgcttcagcttacacacagtgtgctgcacccactgtcctgtgcccactgtctgtcactccttagtgagatgaacccggtacctcagatggaaatgcagaaatcacccgtcttctgtgtcactcacgctgggagctgtagactggagctgttcctatttggtcatcttggctcctcctcctaattcttgaagatttcattggctaaagtaaaacaaaaattctgctcaaaatgaagccaaaatattttgagtatttgcaaaacaatgttgatactatgagtggagttcttaatgttgttgtgttcaaatacaatgtgtgaaacataatgaagctcagtaactttcgtgtgtaacttttggattagaataataaatatcaatataagcccataaggttttatattatttttatttttcttttcttttttttttatggcttggatgacactttattttcagatccaatactagaagttgtttccatgttcacattttccttcctggtttaaaaaaaagagttgtatttttttttttttgctttttttaaattatactttaagttttagggtacatgtgcacaacgtgcaggttagctacatatgtatacatgtgccatgttggcgtgctgcatccagtaactcgtcatttaacattaggtatatctccaaatgctatccttccccccattgtatttttcatagcttaaaaatcattgacatagaataattccagctaaagtacgtattaaatccctggaaaataaattttgtcttaacaaggtaagttgtgaaaagatgttttgtcacaggaaaaaggaaatcctccatttaaaaccctccatgctgaaataaaggaggagtcccatctttcagtcattccacttcaggcttttgatataactaatctcttttcttcttctttccttttttggcaagctttcggaaacaaaacaggcaaaattttgtgatgataaatatcacagttgccacgcaggccagcaggaatgctatcacatccaaagagtggtactggatccaggtgaggttgtgagctgcgactcgaaggtgcttggctcctttgtggcgcatgacaaactcaatccagaagactgctcgatccaggggcttcattggttggtcatgatgaattcttgataatttcatgacattctctttatagctgaaggataaatataaagatatcaacattaaaagtaaatttattgcttaagcatatcaagtctatggatggtctttgaaaagtgtcacacaaatgattgaaagtaagtgtcactgaattggcatgaaatttcaatgttttaattcatgtcattacagaaagtttggtttttaaattggagttttatcactgacaaatacctttaaaaatgaaaaatggaattttcggtgggaaagttaatgttttctggagcagaaaatattatgagccattctaagtgctataagtaagatagtggaaatggaatttgagaatgatctttttgatctttttaatttttttttattttttgagacaggcttttgctccattacacaggctgagtgcagtcacatgatcatggctcagttcagcctttctctttcggtctcaagtaatcctacatctcagtctcatgagaagctaggactacaactgcacaccaccatgcctggctatatttttttattttttacacttttagatatgaggtgttgctgtagtgcccatactggtctggaactcctgtagtcaagtcattctcctgcctctgcctcccaaagtgttggccctacagacatgaaccactgtgcccagcccattttgacgtatttaaagaagaattgtgacacaactggtgaaatgcctcctaactagtttctcagcttctactctaatcttttgtcttctaccatattttccttctagtagccagaatattttccaaattaatatcaaattatgacactcacctgttaagatttccatctggtttcttgttacattaagaataaattccaaatctgtctttggtctagagaactctacacaggcacctacttgtcctagccctttccccctgtacactttcttctagagacaatggccttcggtttttctctaaactcctgaaggtgttctcaccttagcccctttacaccttttgttccccgtgtctctctcattgagcattctttcttgcaactacttgaggtttgcttctatttctttttgaggcttccccttgtatgatacctcttggagagtcttttcctggccacactataggcacccataggatttctctagtgcttcatgcttactttgctatttgatttctggaactttaaaatatgttgtatatcttctacagtaaaacttcaagtatgaaatacataggataaatgtatatatactatgtgactacctcaaaattttaagattatcttaaacattatcccaaagtgaagacaccaatttatcacaaactgcatagaagaactctctcctcctgggccattttagtcactatttttatcctcaaagtaagtattaacctgatttctgatatcatagattagtattgtttatataattgaattaaataatacatattcatttctgtttttggttagcagttgtttaatagcattggtgtagagagtattcagttgattgacaaagaccacagatgatctcttcattttgtgattaatggatatttgtgttgttaacattttttgaccttactaataattatggtattaagatatttgtatattttattaggtttaaatatttattcatttttgttggatgtatacttggaagaatagttgatgagagaaaggcacatttataattagaattttttgttgactgaattttttaaaaaatattttttattttaaagaatcagattgttttcagttatcgtttttggatgatttataatttatttctagtatgactagaacatataatttttatgaatttgaatcttatacaatttacttagtgtttatttatggcccagcatatggtaaattcaggtaactatttcatataatctttttttttttttgagacagagtctctctgtcacccaggcttgagtgcaatggagtgatcttggctgactgcaatttgcatctcctgggttcaagtgattctcatgcctcaatctcccaagtatctgggactacaggtgctcatcccctacatctggctaagttttgtattattagtggacacaggatttcaccatgttggccaggctggtctcttaactcctgacctcatgtgatcctcccactttggcttcccaaagtgtcgggattacaggtgtgagccaccacacccggtctccataaactcttttaaaaatgtttattttctgtctacacacacacaaccagagatatatgtatggatacatatatacagataaatgtgcaatatatatacacacacacatatataacacatagattacatttaattgtgtacttcaaatgttttatctccttaaataaaatatttcaaagatcactattttgtcttttctttttggtctgcttaaatttaatgtgagtactggtaggttcacttttttgtttttttgcttttttgtttttttttgagatggagtctcgctctgtcaccaggagttcagtggcactatctcggctcactgcaacctccgtctcccgggttcaagtgattctcctgcctcaacctcctgagtagctgggactataggtgcacaccaccatgcccagataatttttgtatttttagtagagacagggtttcactatgttggccaggagtatggtctcgatatcttgacctcgtgatctgccctcctcagcctcccaaagtgctgggattacgggcgtgagtcactgcacctggtcagttcaaatttttttaaaaagttttatttttactttaagttccagtatacatgtgcagaatgtgcaggtttgttacatacgtatatacgtgccatggtggtttgcagcaccgatcaacctgtcatctagattttaagcccctcatgtattagctatttgtcctgatactctcactccccttccatcccccggtgtgtgttgttcccctccctgagtccatgtattctcattgttcaactccctcttataagtgagaacatgtggtgtttggttttctgttcctgtgttagttgctgcggataatggctttgcatttcatccgtgtccctgcaacagacatgatctcattcctttttatggtgcatagtattccatagtgtacatgtatcatattttctttatccagtctatcactgatgagcatttgggttggttccatatctttgatattgtagatagcgctgcaatagacatacatgtgcatgtgtctttatagtagaatgatttatatgcctttgggtatatacgaagtaatgagattgctaggtcaaatggtgtttctggttctaggtctttgaggaatcaccacactgttttccatgatggttgaactaacttacattcccgtcaaaaatgtaaaaagctttcctatttctccccagcttcaccaggatctgttgttttttgactttttaatcatcgccattctgactggcatgagattgtatctcattgtggttttgatttgcatttctctaatgatcagtgatattgagcttttttcataagtgtgttggctgcataaatgtctttttttaagaagtgtctgtttatatcttttgcccactttttgatggtgttgttttttttttttttttgtaaatttgtttaactttcttgtagattccggatattagacctttgtcagagggatagattgcaaaaatcttccctcattctgtaggttgcctgttccctctgacgatagtttattttgctgtgcagaagctctttagtttgatttgaccccatttgtcaattttggcttttgttgcaattgcttttggtgtttgtgtcatgaaatttttgcccatgcctatgtcctgaatgatattgcctaggttttctcctagagtttttatggttttgggttttacatttaagtctttaatccatcttgagttaatttttgtataaggtgtaaggcaggggactagtttccgttttctgcgtatggctagccggtttctccagcaccatttatttaatagggaatcctttccccattgcttgtttttgtctggtttgtcaaagatcagatggttgtagatgtgtggtgtttttctgaggcctctgttctgttccactggtctatatgtctgtctttgttccagtactatgctggtttggttactgtaaggtgtaaggaaggaatccagtggcagttttctccatatggctagccagtttttccaaaacatttcttaaataaggaatcctttccccagttgcttgtttttgtcaggtttgttaacaatcagagggttgtagatgtgtagtgttatttctgaggcctatgttctgttccattggtctatatatctgtttggtaccagtaccattctgttttggttatgtagccttgtagtacagtttgaagtcaggtagcatgatgcctccagctttgttctttttgcttaggattgccttggttatatgggctcttttttgtttccatatgaaatttaaagtagtttttttctaattctgtgaggaatgtcaatggtagtttgatgggaatagctttgaatatataaaatactttgggcagcatggccatttttacaatattgattctttttatccatgaggatggaatgtttttccatttgtttgtgtcctgtcttaattccttcagcagtggtttctagtcctccctgaagaggtccttcacatcccttgttaggcatatgcctaggtattttattctctttgttgcaattgtgaatgggaatttattcatgatttggctctctgtcaaatcatgtactgtcagtgtatagtaatgcttgtgatttttgcatattgatttttgtatccagaggctttgctgaagttgcttatcagcttaaggaattttggagctgcgacaaaggggttttctaactatagaattatgtcatctgcaaacagagacaatttaacttcttcccttcctatttgaataccctttatttctttctctagttcacatttaaatccagcatcttattctatatatatatatattttaattttctaacctgttttatgtttctttactttcttactttttttgaagtatcttaaatcatttcttgtcttactaattttttggtaaagtgtttttaatgtattcccttagctggtaccacctaacctcataataatattggtaggagtaatagactctgaattgatggtagctggtctaggcacagcatttttcatagtatttcctttggattatggaaaagttaagtattacatatttattttatcaacattgaaacctttgtatttcaaaaggcatcttccaaaaagtaaaaaaaaaaatctatctgtccatagtggaagaaaatatttgaaaatcacatatttgataagggattgtatctataatatataaataattcttatgaatccataagataaatagaaaaagacaaaatattcacaagattaaaatagaaatttatctaaggaagatgtgtgaatgaccagtaagcacatgaaaagagggttaacatcttcagccataaggaaatgcaaatgaaaaccataatgagagaccactttacacacactagaatggctgtaatagaaagacaggtgataacaagtgttgggaagagtgtgaagaaattagagccctcctatccagctggtggtaatgaaaaatgatgcaaatactttgaaaaacagtttagcagttcttcataaacaacaatttcccatatgtctcagcaagtccactcctagcatctcctcaaaagaagtaaaaacatatttttacacggaaaatatgtataacaatgttcataaatgccaaaattggaaagacctaaaatgtccatgacctgataaatgggtaattttggtataaacatatcaaagaatattatatagaaataaaaatgaatgagttctgatacatcctacaacataaataaaactaaaactaattatgctaagtgaaagaagtcatttatgaaacaccataaattgtatgatttcatttatataaaatatgtgaagagaataatctattgagaaacaaagtaagatggtatttttctaggactagaggtttattgggagtgacttcatacattatgagtttaatttgaattcattaaaatgttctttagggctgtggctttgtaactatgtaaacatactaaatatatttagattttaaattttagtgaatgttatgctatgcaaattataattcattatcacatttcttaaaataatgataataaaaataaatttttgagaaagaatagattcatactttcagaaattttaggtattgaattgaaatatcatatttctctagttatgttctttcttttcattgtgcattctatcattaaaaatatttaaaataattatctacatatctttaatttttttgattttataattcattgcagtcattggtgacccattaaatctgtggggttgaaatgtaactttgaaataaactgtctggtggaaagtaaggacagattttacattggttaaatcacttcaatcccttcaaaattagtctcttaaaaacgggttaaaattcatattcactgttgacaaaataatttataaataccacctggtcacaaaactgtaatactcacacagggtcattaatgactgacttcaatgcattgagcaaatctctacttgacatggtcctgatgtccacactgagggctgctcccttggctttcatgtgagcaatgttatcatgttgatccgcaaacaagggaatgcccaccatagggatcccatggtagatcgcctcatagatgccattggttccaccatgagttataaaagctttggttttgggatgacctaaaagtggatgcattttaacaaaattattaattacaaggtatgagaattgaataagaaatgcacaatataaggaacttaaagcaaaactgttccctaggtaacattatacccacaaaactgcattgaaattgttttcaaatttcagaagaattgccaggtgaacaaaatgaaaaagcatattcttaattaaaaaattaaaatgtgcaaaaaaaagaataagattgggtatacaagaacgtggtcttttaagtattataaataatgaggtcacatttacatatttaaaaaatatttaaatacttaaaatatttaaaatatttaattttttttaaaaggcagcagggagtagggtggaggtggggctgaggaaggaccagttatgcatcatcatgaaatgtgttatcattttatcatgataaagattggttatttattcccataaaaagtagagtcactggtaatagaaaagtgtccgctatttttcagtgcctgttgaaataaccctgcagtaggggaaagaacagaggtaaagctgcataaataggagacagacagaaaatccaggatgttatttaaaacctgtgagaggaaattacacctgaacaaagagatttttattctgaccataaagaatgtgactgtatgtaataaaatgccaactactatagtgcattctttttatactaagactggaaaataaatataaagtagttaaatttgatttgttttttagttttccaataataaatgctaaatatgtttgttttatgttgaactattatcactccaatttgctgttactaatatattcactgtttgttctccagaatcttaccaagaaggtcattctggggtaaccacttgtacagtcgagtattggaacctaaagtatttggcttcttgccatcaaatctccatagaacctgttagggcaaggaaaatatcttgttcaatgaatagaactctaaaaacatagcatgttagaattctgaagagattaataatcagttagttaatccatataaaagatgaagaaataagaagaagtgatgtcaagtaatgagaactactaaaagtttgaggtaagttgaatacccacgtttaatgtcgttacttttataatcaattttgtatataaagaaataatgacatttctaacataatagctagacacatgagattgtgaaaggaaaataaatcttggcaacccaaactctatgctaaagggaaaagttaagctgcttagggcaaacctacctcccattctattcaaagtcagcccttgactcactgagataaatgaatatcaaattgcctcatttcgagaggctaatcagaaactcaaaggaattcagctatttgtctctcatctacctatgacctggaagccccttccatgcttcaagttgctctgcctttgtttctagctgtcccccatttctggaccgaacaaatgttcatcttatatatgttgattgatgtctcatgtatccctaaaatgtataaaaccaaactgtccccccaccaccttggacacatgtcatcaggacctcctgaggctgtgtcatgggtgcacattttcaaccttggcaaaataaactttctaaattatctgagaactgtctcatatattcagggttcatattttggtaaccatgaagagattctgagtggaggttccctgacctttgataaatgtcctatcagtgcttggtaccagcatgagctaaatttatggctcaaacaaagaagacaattggctgaggtctgggagcaacccctccagagaatctctgataccccaaaattcagacaagatctgaagtttattttgctgtacaactcctttttgttttttttggagttttacttgcttcctacaagaaaggcaagatttcctgtttccatgacaatggaaggcaggtaactctatggagtttgagctcgctcccaggagggaggatgaatttgaggtttctttcctgattctaggatggcagagggcagttttggcctgaaacccatccgtaggtaaacagctgaattgcggttttgtcttggttaatgtttaacaactagctggacttaatttctccttaccattacagtgcttagtgatcacatttctgggattttttttttttttgtacattccagtatttctcccatcagatttgatgaactttacctgacttgatcaaatctgagtgagaattccaaattgtgggtaacaaagcctgtctaatttggctaaaattctttgcagacgcaaaagagaaaacaaaacaaaacaaaacaaaacctaaaaaccatgctcttggtttctgtgtttgcttcctgtctttaaaaaaacaaatgttcttttgtttacttttcctccaccctatacctccttttgccttttgccatttgcagtatgaaaaatctagagaaggcttctaatgacttgaactcttttaaagaattcagaacaaaggcaccactcacccctttaggggtgtctgttttctttgtggagttccaagagttgtgggcagatttttttctcagtccaaagctctgttttcctatgttgaatgacctgatctctttggctttgagattaccacagattaccttgtactgtgagaggattttaccttggcatgtgtaatggcagacgagttacaaagtagggggtggctgagtacagtttactggaagtagtattgactgttgctatttttttcctcctaggaagttgttgtttaagaatcctaattctagtttggagatgtgttgtaaagggtctcctctattgtttttattccccaaattaatctcatttggcttgtctgtgtggatttgtgtgagaaactgaactgtggtttacataggaaaatgagagactgagttttctcagctccaaagtgaaagggcatctgctcctcccaggcaaaaggcacccctaagcaactgggggccttgtgggagtgtcttggggttgaccccctgtgacatggagtggccctgcagggaaatccccaagaaaaattaacttttaaaaaaaggctagtccaggaaacacatatgagggcagatcacccagcattttgagccctctcagaggtcatacacctctggagagagaaactgagacatgtaagagggtggaaacaactcagtggtgacacactgtggagtactgcccacaagcagcacacattgattcaccacacataaaccctaggccacagctcagttcctccttttaggaaaaaaagtgggaaacaaataatctaagaatgatgagaaaacaagaagaatgaccccctgatatcacttggtaggttttatgacacctctacttggcagagtttatgtaaaatgaaggtaatacggtctttgtgcacatatacattaagaaccctaggttgtcctgcaagctatagagttcctaagttctctctttttaaaaaaaattcttttcttcttgctttaaatttgcttttatttttctattaagataaaaaccacactatggattcaacaggtttttgtctgcaagctggtcaattttttttatctcatggctaaagttctgaagtaaaagccatagaatcttttgtgtgtgtgtacatgtgtttgcatatatttaaaaggccattataatttctataattttatgtttaataggcaattgaatccattttattttccttccagcacaccaaattttttgtctctgtaccttatgatgtaaattttgctatttaattttcacttggtttcttttaatatgcaaatgtaagactatttagcttacaactgcctatggtgatcaagtattcatacagattacctattgaaacaggttatcaagaatttggaagtctaatatggcaaaatgtagttttcataaatctataagatgtacttctattggcatgcttaatgtgtgtatgtatttatgtgttttgtacacaatgttttattactgaaaatatataaaagagctctaattaattggcttaagaaaataaaagtgcttgaattaaatactttgccagaaaaaaaagactagtcaaatgctttttcaagtttatgtaacttcaataaaatcttttataaataagataactttacaattattgctaaagtatgataatattagaaatgtcttaagaatttccagcatatatttttgtttgcatttattaatcaaacaatttcatacttattgttgccaaatactttaaggtgtcaaaatttgacataagggttacaaaactgtaaaccaagcacaaaacagaatgatctttgcttgtgtaattttttaataaataagacattgatattggtttaatgaaaatagccacatcttgaattaagtaagattatcataacttctaaccctgtggccttaagcaatctagtccacaggcagtaaggtttgttttgggaaaaaactgttatcatttttatttcaaagctaaaccataaagggtgtgaaatggcaacactatccttcaactcattttcaactcatataagtttttttcctcaagttctgtttgttgtggcataatgctaacagtgctttctaaaagctattcagctcctcaaggtccagggactatcacagaagaggtgggtgtgtgagattttaagaactgatactgagagataagttagtttatttacaaattaatcattaatgtcaaagacacactaatgcaagaccaacatatgggcccctgtgtcagattaacaaggttttctggaagcataaactgacttcttaataaagattataaaggttatgaaaggctgaggaaagttatatcttatggtcaagattagaattttatagattgttcataaaattttgaaaaacaaagttatttggcttcatgctattttattagggcttattgtttggcaaattgagtctcctctctcaaagaatgaagatttttgcctttttttgaaatccttgagttaccacattagtcaaatgaatgatttatcttacctgtgatattaagtgttttaaacctttgatatttgagaaattttccaaacaaattataaattatgattttttctgacctaagtaatcctttaatttattagtttccctaacatccaaaaatgacataatttggtttattttgtataaaaattatacaggaaacattgtcaaatatgaaatggtgtttggtctttttgagctgtatttatataagtatgttattgttatgtgttccaaaattatgggaaactcctataattctgatatgacttagtgtgtacgttatcagtaacaattatatgtgttaagttattgtgtgccacagaggtaacaaatttccttgtccattgtgtctttgactgagtctgccctaaaactttttgtcctccacagacaattgttgtcttactttggtcctctttagaaggcgattttatactcagccataaaattctaacaggtgctcttgaaaaaaagtttttgataattttggagattgtgacattagaatggaagaaaaactttcaggactcatggagaactaaaatgttcatgagtatcaagcagaacaggaattaactacatggactgaaataataaaaaactaaagtaatcttttagactttgcttaaaacattgctgatcctttgttttgtttttttttcagagtgaaggaatctttttttttttgagctattaacagcttttaacaatttagtatactcctatgaaaaaaatttagaacatatttgtttccctctacctgatttttcagaatttggaaactatttgtgagtattttttacttttgtcaatacagttatttgcataagtgcaataagaatctattttcatttttaacaaaacacaattggagaaactggttattttatcaaggcttccactggtatggtgggctttcctttagggaatcaaacttaacttatggagccaataaaaccccttgggaaaactggcctcataccttcatctataaggtccctgtacagggttcctgaactgtgttaagcaaagaatgtaactttctgacaggcccaggaaccccaagtttattttggaaccccaagaggagaggaattcacccaactcgtaggtatttgatggtagaaatctatggctttcctcagctttaaaaaagtcctatctgagattctttctataagacaaagttccatcaaagccactttaaaagcctatgtaaataaaaaattattcttcctcctctgtatacaataatcaggccaagtataataaagcaaatcagttgtaccatggtttgtctttagtaaaattgggaaactgaagacagaaaaattatgtttcaaaaataacagtatacctgttgttagattctagtcttgcctaatgtttttcaacttttattactgtctacagtttggactgaattctaatttttcatggctacacgtcttcaaaatagtgtcttcaggttttttttcctccctttccaccatttttcctagtttggagtcactgtaaactaagtcatgctttcataaagccctacaaattaagctagacaacttaaacttcagaagaaaataacagcagccaatttacatacataatccactttcttacctgcctactgatttatggacttcagagtaatgggcctatattaattttcaaggatttttcttttgtttggttttgtttttctccctttctccctttattttgtcttcataggacatgagacttcacaacctactaaaaatgaactttcctaataactcaggacctgcttaggaataaaccttccttgccattagagatcagatgaaaacctgagaccagagactcattttcttctaaaatgctttctccaaaagattttttttaaatgtaaaaggaaaataagcctgggggccccaaagtcactaagcaaatcactgcctcccattctattcaaagtcacccctctgctcactgggataaatgcatatctgattgcctccttggagaggctaatcagaaagtcaaaggaatgcctcctccctgcttcaagttggcaaaaataaactttctaaatgtactgagacctgtatcagatatttggggttcacaagattatcaatgaaatattcaaatatttaagaattgttaggcagtcttaattctagtaataaaaaagtagcaaattagtaataacctatatatttattttatatactttatactagctgtaaccttccaaatttaatataaatttattaatttttgagtgatatgagaagagtttacttatatccacttgtctactagtcataagttattttatgaatttgacatcattgattacaaaagactaaatatttaaactgcacatatggtgagaaataatgctacatatgtagtatgtgtaatttcttttcatttgctaactatcaagtgctactttcaggaaaaatttcaagtggcagtgtttgacacaaattcagactattatcagtattgctacttttgtaaatgctaacaatgtaggaaaaaggagcccattgacaattcatgattaacaatacagatgctgaaaatgtagaaaattgtattttgctgcattttgcttaactgatctttcacacttagatgatgcactacctagcattgacagccttgatatatggtcagctatagccagtcattaccatgtctagtaccaaactaaggtactgattttagaattcccaagcaatctttataaactggagtagaatttacaagtgttgaccttgtatttgatatgggagtgttaaagtaactctgtgttttcagcaaaaacttgcatagatcattcagagagggctatgtcagataagaaactaaaacgtaaattgaaaatacacaaagattgtatagattagaaaataagttcctaccatgtttatttatattttctgctccttcctcaatctggagaaggcactaatctgattcttagagcatagtctttgttgggccacatttaataatgcacatagtctaccctaaaagcaggattctatctccatcctttccattacatttttctgcttaagacattagtggcacccaagtcagcagagcagacaagttttttttttttttctctaaatctacttggctaggtgggtacctccagagcagtggctagtcagactaggacattctttctctgaatggcaccctgaacagaacgctaaatagacctattccaatgcatgggaagtaaaaacagccagattgcttggtaagacgaagctgcatgatgcatttcaaagttttttcaatacctgcttattgttattgtgatagtacagtaacttattaaaatttaactgctttttgataatatctacagtgtatacagtaccttctaaaatcctgtaaaccaaaaggagcaaatgacagggcagaatttagtgatttctatgtacatgctacgataccatgataataccaaacttcactagcacctcttaaatatatttccttctgatcacaatattaatgccaacgttattatcaaccaaaactcctctctttatgattttaagatcttccatatatgtttttgctttgaacagatgtctgagataattagaactatcatagcagttaaattttcaggcagaacatttctgtaatggactcttgaagagtttaacagattcatttagtagccatccacagttaaggcactttatctaaccttttgtgggatctgggcaagggctgatgcaatcatgttggcactttcttctgacatgttactgatcatcgaccccagagaaaacaccacaataccattttctccagagctctgcacaaactcttccatttcctgtgaagaaagaatttgttctatcagaaaagagcaacagcacagaaaacactattgacaggattgttacaaacatctaagatgagaaagtcaggagctattggagtaatttttttaaactgacctaatcattcagtttctttgaaaggagatgtgtaatataatatatgtgggatctttcatgcaaatttgtgtaaatatgtgtgcatatgcatgtatgtatgtgtgtgtaaggaggaaatgaaacaaagctatgacactgcagtaggaggagataatgctagaaaatgttacacccagacactttatttataatattataattactaacataggttattggaaggtagctttacttggcttcaattctaattttttttgtggttctactaaatctcttgtgtttatttggagtagttttattttattttatttttttctgttcagttcttttagttaggagtcattggagccattacatgactatgagcaatgaggaaaagttagttacaattggaatgatattatatctacatttatttagcttctagctctctaaccctttatatttcacttaaagttagggtttcctagtcttaccccactacccctcactgcccccgacacccccaccccccaaaaacaccttaaaagctgaagtataagaatcactgacattcagcagtctggtattgtggtttggaatttctgggaaatagttctgagaattccatttataatacagtattatatactatatagttacataattaagtgatcttatttctcaggtcattgcttaggtatgactatgacaccttttgtcctgaaatcacactgtgaatttgatgtgctatgtataactgaatgtgggggaccctcatcatcactttgctgtgtctcacagggggcacttgaaccacagtgggagaggtcaccaggactttctccagtggagatctgctcaccccctagagtagctccctcacactatatgaagctcctggtgaatatgtgtttgctttgaaatgaatgagaattattctgacttgtgtttcctgatgtgtccctgtttttaaacttaaatccattctctaatgccacatcgctcaatgtattctcacaccaaaaaaaaaaaaaagagagagagaaagaggaaaagaaatgtagacccataagtttcctggatatcatatcaaaattgtatactcatctttttgttgctgttgtcccttttgttctaaattctctttttctcagtaaaataatgaccaaccccttctgtcataacaaatatactttctggtcctaatcattgggggaaatttctttataaaactgtttacaaataaaaaaagaaattctaaaatatgtcaattcagaccatatattggtaagtatttttaaaaaatataatttaactttatgacatcttttttttttttccagatggagtctttctctgtcacccaggctggagtgcaatgatgcaatcttggctcattgcaacctctgcctcccaggttcaagcaattctcctgcctcagtctcctgagtagctgggattacaggcacctgccaccacgcctggctaatttttctgtttttagtagagacaggtttcaccatcttggccagagtggtcttgacctcctgaccttgtgatccacccgcctcagcctcccgatgtgctgggattacaggcatgagccactgtgcctggcctgacatcagttttaattggagattcagtgtatggctattagagataattcatgaggcatccaggaactcagtgtaattgcagttgcctgtagccacatttaatgtaacttgagttcaatgttttgtctcattcactgccaaaagtctgcttcacccacccagtattgaagtaataaaacatctatttatagacagatcagcactgatctcattctgtgatgtctttatgaaagtaatggtaatagaagatcaatgtaagtagttttataaaagtatgaaaatttagaaaaagaaaatcatttacccatatctctatctcaatttaaaatgtgtaccatttcattatgggtttaattctatttatataactcaatgtacatatgtgatgtttatttagaaaattttattctcattgtatatgcctttttattctacaaaaaaactgtgatcttgttctactcatcattttgttccttagtttccaactatacctgtaccacggctgacagtgtaattaaacattgttttgaaaaaaggattgtaatggcttggtatgcacattatgtaagtttttaaccatttcttaatgtaagatatttgaattatttccagagtttttttaatgagtatttgctaccgatattgaatcttaccatcatgatttattctctgtacagtttcatgtgagtatattataaaggcaatgcctatatgcatttttcaaacacttgatactttttggcaagagtcttattcttttgaaatatacaaacattatctgagaatctaatacataatggaaaagcaagcaaatttgtggcaacaattattttgtgtacaaaagaattagagaatcagtttcacaattatttacttggattcaagtctaccttctgcaagttaacaacaacggaggctcacacttgtaatcccagcactttgggaggctgaggcatgtggatcacctgaggtcaggagttcaagaccagcctggccaacatggtgaaactctgtctctactaaaaacacaaagattagtcagatgtgttggcaggtgcctgtaatcccagctactcgggaggctgaggcaggagaatcagatcgcttgaacctggggggtggaggtttcagtgagccgagatcatgctagtatcagtaataatcactattgtactactagtcatttatcccttgtccttattctgctactctcttccccctgctactggcactatcactttcttttaatgtgagtgaggaatttttttttgagaataagataagagtacacagaattaccttttaagctagaatattaatgaagagcctccacctttacaatacaactttagctttccagcttgttcaactgactgcccaaacttaaacatttacatttaaacaagtacacagagtatctgttctctaggactttgctagagaatataatcttgatgtgttggaaaatcaatcactattaaatgaagactgatatcttaaatggctggcacatgttagctaatttaaagtattaaaaataatgactaaaataatcataatatcaacaatatttttggatcactggctgtgtgtcagagacaacttaagtgttttatctgtggtaactactttttttccacacagcacaatatgaagttgtgattattattataaaagtagtcatgattgcttaaactcatgtaaaagttcctaaatgatctttacattttacaaacttgcctttttgcaatattatacattgggaatattgggattttttaaaaggaaatctgatcatatctcttcatttcttaactcttttcactcttttcagtagctctccattgtccctatgggtatatcaaattacatatatatatatatatattttttttttttttgagacagattctcactctgttgcccaggctggagtgcaatagcgtgatctcggctctctgcaacctctgcctccggggttcaagtgattctcctgcctcagcttcccaagtagctgctattacagtcacctgccaacatgcctggctaacttttgcatttttagtagagacggggtttcaccatgctggccactctggtctccaactcctgacctcaggtgatccacctgccttggcctcccaaagtgctgggattacaggtgtaagccaccacgcccggcccatcattgacttttactcaaccttttcctgtaaattaaatttggagttcctgggaactgcccttattgcttttctacttttctgccttaatgcaagcctttactttttttttttttgtttatttgtttgtttttgagacagagtctcgctctgtcgcacaggctagagttcagtggtgtggtctcagctcactgcagcctctgctcccagactcaagcaagcctcctgcctcagcctcttaagtagctacgactatgagactacaggcacacaccagcatgcctggctattattttattttttatttttgttagagatgaggttttaccacgtttcccaggctggtctcaaactcctgagcccaagcaatcatgccttctctgcctcccaaagtgcagggattataggtgtgagccaccttgcctggcctctggttttctttttgggtgtttctcatcccctcatcgtttcacctatctctgcacattattgagtactcactttaattgtcaatgagtttgggatctcttctgcatatttctttatcattgtggtctttccttataacactttttagacttttctttttcattgtttttattctatctttcaaagtacaatgtaaggcatgagggagcagaaactgtgctacctttattctctgaaaatccagcacttacctgtggtttgtattaatcactctacaaatattttttgaagaaatgaatcatactatcttttgggtggcacaatgaaggccttactttaaccaaccctgttttcaaaatctccctagtaaacctctttggtctttaatgataataacattcacatacttgtgatactacagaaatatatgattttctaatggcaagtccttgtttttgacctcccatattcccctcactctgagttaaacactctgaaagaaacatatccagccattccttctgaaaatgtcaagcaaacaaatgaaacaagaacacatttaccttaggcaggggtttggctggtttacagtgaagtcctccaacaaaatcaacatttggtaagaatgggcgaggaaattcaaaatcccaataggttcgaatgagccacatttcagctttccccattgtctcaaataatgtagtgggtcttcctgatggaaaaaaacaaaacaaaacaaaaggtagctaacacgagaattgttatttgaatatgcaggtattttcctgaaaggacttggaataacatacccaaacatatataaaatgtctgtgcattgataaaatatatataaatacatttatatatagtcataatttagattttatttattgcatatgttgctcatatgtatatataaggaaggcaatgtattcagagatctgtaagaagaaatcacatctttaatgtaacatcagtatattcacaatcataaataattattaaaataagtcactaatatggtttgactgtccccacccaaatctcctctcatcttgaattataatccccataatccccatgtgtccagggagggacccagtggcaggtgattggatcatggtgtggattcctccatgctgttctcatgatattgagtgagctctcatgagatctgatagttttataagtgtctggtatttcccctgcttgcacttctctctcctgccactaagtgagaagatccaagcttgcttccccttagcctttcaccatgattctaagtttcttgaggcatcccagtcatgtagaactgagtctattaaacttcttttctttataaattacccagtctcaggtatttctttacagcagtgtgagaatggactaatgtagccactatgaacttaaatacacatttgtcttccctctgaagctgcaatagtaacaaatatacctttaaacaactctttcagttccacaattaattcatcttaccttacccatgaaaacagctttccaggaagtactctagtgtctacagtttattaagctagtcccttgatccttggttctcaaagtaaaccatgagttttttgagctcaacactgaaatctttacacctactactgtcttggttcatcttaagatcttaatataattagatttttaaaataaatatatttacaaatgagaattaaaacattttcagaatttattgacatagagatatgtgctctcccttaatttggcccctattttctttgatggagagatgcagtttaataaaatatagattaaaacttagatgttcactttcaacaagatttcagtttttgaaagaaataattgtcaacctgttattgaaggaatgtataaacattagaaatctcaagttttaggcttctgtttctggagtagagccactatattactcaactgtgaaggaatccttcttacatgaaaaacaaaatttaatttctaaatgaggaaactgaggaactcaaagagaaacaaattcctcaatcctgcattgataatttttctagaaatatgtgtaaatactaaatttacgtgtctgccttcatgaagatgtttcttgaggtatctattgactttttttaaagatgaaaaaatgtatagcaaaatgatatgtgatagtttaaagaaatcattagtgctttacaatgaaggtttatgactctctgggtgtcctgtagtagtgatggccccagggttctaactgattctataaggtcaacattctataatatttttgagactgatagatcatcttacatttgcaattcataatttcccttaaaaacactatcttctgacattatatttatataagctcaccttcaaaggcacagaaaagttagaacttaataagcaccagttagacacatgacttacctagaacttcactataaaactggtcccacttcttcagatcataaatttgaaaccaaaagtcaaaataaagcatatgtatcatattttttatcctctccatgaaaatcatttgatcacttaattctgacataacaacaggtacataggaaggagggaacagaaatcctccaccattcttctcaaatgtgtagccaacagagaatcgaagactgtacagaaagggtatgttaaatagttcagccagtagctcaccacagggattaagggcatctgccagaatgacatcaaactttgactcttgtagtttcatcataagtttcttattcaaaactgcatctttacagagcttgttactgtagtcataatattcccaacacaattcttgtaattgtgaaaaatatgaccaaaatgtattttttgaaacaccatatatccatctatcgagaattttcagaagagaatcttccaaatcatttttagttaaagatgtaggataaacttctaatttaatagcagatgatttactggcattgacaagagtagaagccgaagatgtcaacacagtcacctcatgacccctctgaacaagctcttccaggattgtcttcatatttatccaatggctgtattctgtgggccacactagcacctttccacagcttccagagctaaagtaacaactgagctgtatcagcagaaagactgacgtccatttcagagacatcctggtcttatgcaatgcttcttttccagttgttgttt

SEQ ID NO: 982 - DNA, 3609 bp, Homo sapiens
aggcacactctaccaccatgaatccactcctgatccttacctttgtggcagctgctcgtgagtatcatgccctgcctcaggccccaaccacccccccgttcctggccgacaaatgcccttccattcttaccacctctcctcttttgactgtgctctgatattccgtttcctccatctggcatatctccttcccatcctccttgggctctttttaagtctcacctgttcaccttctccttgacttcactcccaccactgtcattcatccatatccgagttgtggttggagaagctgggaagggggccaggtggggctgtcccacgaaatgaagcagcaggcttcaggcttggctccgacagcaacagaatagcaccactatagctgctcctaacctcgaatgcacctggggaggttgaaaaattactcatgccagagactcagctctagaaattctaacttcaattgtctggggtagagcttgtgttctgggcttttaagcttcccaggtgatttttaatatttccagccatgcagccaaggttaagaattgctgtcctattggccaataacaaagtctacctttgttctgccaaagtgagcctgggggctgccctcaactctgccctgactgcacagatctgagctatgggggaaggtggtcatggccaggtctatgcagacagggggttttcctagcttggcaaaagaatcctgacaatccagggcccaaatagccaggggaagtacacaggtgatgaataaaagagagaagcactcagtgggagagacaaccacatcccaactcctatcccactggaagcattgtgaggacattccttgcgacttcagcctggtgaccccaggagagctcggatcctccgcagggtacctagctatgtgccctgcaggcacagagacttgggagccacaggcagtgatgatcaccaggggtggcagagctccctcccttgcctagcctcactgtgcttgttaaggatttctaattagcagaaagcaatcacaggctgggagcgccacccctaacatgctattgacttgccttctcccttcccatctccactccagttgctgccccctttgatgatgatgacaagatcgttgggggctacaactgtgaggagaattctgtcccctaccaggtgtccctgaattctggctaccacttctgtggtggctccctcatcaacgaacagtgggtggtatcagcaggccactgctacaagtcgtaagtgtggggcccccgactgcaaagctcccggccagtctgcctgggagagcttggcttcagcccagggaactactgaggttgggtaagatggatgggagaggtggtggagaagaaaacttgttggcagctgcggactctccagagcagagagtgaacacaagacaggaacctctcacacccaggcaaatccatgaaacagcaagggttgtggtcataaaagcaggcagggatgatcttggggtggtgagagctagtgagaaaagcaggcaagtatcttttgctggttagctacacattaaagccaactaagaaagactttttaaaaatacagatgcctttgtcctatcccagggcaattaagtcaaaattttcaggaagagggtgtgaatatcagtgagaattttacactctacctctgctaactgtagagtgtatagacagagctgagaactgctgcctacaccaagaactctcaaacctgagtatgcatcagaacgccctgcaggcttgttaaggcacaaatcactgggccccttccccaaggttctgatcagtaggtgggggtaaggaccaagaattcacatttctaacaagttcccaggagatgctaatgctatggctacccttggattagattacacagaagggtggttctcaccaggccaagaatggagggaggaacaggcactgtgcacagttggcaaaggcctggggtgaagaatgctgggaaaacttcaaggagctccttgtgcccacagtgctagtgactgtggagattgtgggaaagagtctggggaggcaggttgaggagcagcctctggtgggatccctttgactcttccccaccccactaccaccaacctctggagcagataggtcctgggtctcataccttcactgacccacatccctctgctgcccatgcgatatggccacacaccccaccccatgcctccagagctgtccatgagcagagagcttgaggaacctggggaaggtgggataggtgccctggctgtgggagaaggtcttcaccatgcctgccctgcccatcagccgcatccaggtgagactgggagagcacaacatcgaagtcctggaggggaatgagcagttcatcaatgcagccaagatcatccgccacccccaatacgacaggaagactctgaacaatgacatcatgttaatcaagctctcctcacgtgcagtaatcaacgcccgcgtgtccaccatctctctgcccaccgcccctccagccactggcacgaagtgcctcatctctggctggggcaacactgcgagctctggcggtgagtgggacccttagtccttctacttccctccatcctcacaatttccagaacaaaccatgccccttaacttgaatcctctcacctccaggcttaagacacatttcgagtgcccattacacacagactctgcactgggcaccagagagatgcaaactatcaaggacttggctcctaaaatcaagagacaggacaaatggagaacttgatatgatcacatcttgggaggggttcaacaatgatcattctgggaactaaaagccagagtctcttgccaggacttatgttctggagtcctctccaggggctgtgttcctcttcagttttccatccaagattattgtctccttctctggcctgacccacatttctacttcctttgatctcttcctgatcctcacagccgactacccagacgagctgcagtgcctggacgctcctgtgctgagccaggctaagtgtgaagcctcctaccctggaaagattaccagcaacatgttctgtgtgggcttccttgagggaggcaaggattcatgtcaggtgatttgaccaacccttcccatgctgaggctcccactgatacctaggccccaccagggaaaaggatttgaactcaaaaggtggtggggctgaggaggctccctgcagtgcccacatggagaagtgaggaagactcccttgggctgcatcttgtctgcttaggaagaacagagaatgggccaccatgagaaggacatggagccacagagctggctggaaaggggtcttttaaggttcagagtaaatgtagctatattcctcctccatctctccatacaacttgtcccttcttccccccagggtgattctggtggccctgtggtctgcaatggacagctccaaggagttgtctcctggggtgatggctgtgcccagaagaacaagcctggagtctacaccaaggtctacaactatgtgaaatggattaagaacaccatagctgccaacagctaaagcccccagtatctcttcagtctctataccaataaagtgaccctgttctcactgtc

SEQ ID NO: 983 - DNA, 3586 bp, Homo sapiens
accaccatgaatctacttctgatccttacctttgttgcagctgctggtgagtttcacgccctgcctcaggcctcaaccaacccttccctggcagacacatgccctgccattcttgccacctctcctcttttgactgtgctgtgatattctatttcctccatctggcatttcttcttcccatcctccttgggctctttttaagcctcacttgttccaccttctccttgatttcactcccaccgctgttattcatccatatccgagctgtggttggagaagctgggaagggagaccaggtggggctggcccatgaaatgaagcagtaggcttcaggcttggctctgacagcaccacaatagcaccactatagctgctcttaacctcgaatgcacctgaggaggctgaaaaattactcatgccagagactcaactctagaaattctcacttcaattgtctggtgtgcagcctgtgttctgggcttttaagcttcccaggtgatttttaacatttctaggcatgcagccaaggttaagaattgctgttgttttgaccaataataacgtatacctttgttctgcaaaagtgagcctggggcttccctcaactctgccctcactgggcagatttgagctgagggggaaactggtcatggccaagtcgatgtcgccagggggttttcctagcttggccaaagtagccagacaatccggggcttaaataaccaggtggagtacacaggtggtgaataaaagagagaagacttcagtgcttgagacagccacatcccaaatcctatcccactggaagtattgtgaggatattccttgcgtcctcagcctggtgaccccaggagagatctgaacccccacagggtacctagctacgtgccctgcagacacagagacttgggagccacatccagtgatgatcaccagggctggcagcgctcccccccttgcctagcctcactgagcttgttaaggttttctaattagcaggaagcagccacaggctgggagcgccacccctaacatgctactgacttgccttctcccttcccatctccactccagttgctgccccctttgatgatgatgacaagatcgttgggggctacatctgtgaggagaattctgtcccctaccaggtgtccttgaattctggctaccacttctgcggtggctccctcatcagcgaacagtgggtggtgtcagcaggtcactgctacaagtcgtaagtgtggggcccctgactgcaaaactcccagccaggctgcctgggagagcttggattcagcccagggaagtactgaggttgggtaggacggacgagagagatggtggaaaagaaaacttgttggcagcagctgactctccagagcagagagtgaacacaagacaggaagccctcacacccaggcaaatccatgaaacagcaagggttgtggtcataaaagcaggcagggatgatcttggggtggtgagagctagtgagaagagcaggctagtacttttgctggttagctacacattaaagccacctaagaatgagtacttaaaaatactgatccctgtgttctatcccagggcaattaactcaaaattatcaggaagagggtgtgaatatcagtgagtatttcacactctacctctggtaactgtagagtgtatagacagagctgagaactgctgcctacaccaagaactcttaaacctgagtatgcatcagaactccctgcaggcttgttaaggcacaaatcactgggacccatccccaaggttctgatcagtaggtgggggtaaggaccaagaacttacatttctaacaaattcccaggagatgctaatgctatggctacccttggattagattacacagaagggtggtgctcaccaggccaagaatggagggaggagcaggcactgtgcacagttagcaaaggcctggagtgaagaatgttgggaaaacttcaaggagctccttgtgcccacagtgctagtgacatggagattatgggaaagagtctgggaaggcagattgaggagcagcctctggtgggatccctttgactcttccccactccactaccaccaacctctgaagcagaaaggtcctgggtttcacacctgcactgacccacattgctctcctgcccatgcgatatggccacacaccccaccccatgcctccagagctgtccatgagcagggagcttaaggacccatggaaaggtgggaggggtgccctggctgtgggagaaggtcttcaccatgcctgccctgcccatcagccgcatccaggtgagactgggagagcacaacatcgaagtcctggaggggaatgaacagttcatcaatgcagccaagatcatccgccaccccaaatacaacagccggactctggacaatgacatcctgctgatcaagctctcctcacctgccgtcatcaattcccgcgtgtccgccatctctctgcccactgcccctccagctgctggcaccgagtccctcatctccggctggggcaacactctgagttctggtggtgagtgggaccctttgtccttctacttccctccatcccacaatttccagaacaaaccatgccccttaacttaaatcctctcgcctccaggcttaagacacatttctagtgcccattacacacaggctctgcactgggcaccagagagatgcaaattctcaaggatgtggctcctaaaatcaaaagacaggacaaatggagaacttgctatgatcacttcgtgggagaggttcaacaatgatcattctgggaactaaaagccagagtcccttgccaggacttatgttttggagtcctctccaggggcagtgttcctcttcaatgttccatcctagactattgtctctttctctggcctaacccacatttctttctttgttctcttcctgatcctcacagccgactacccagacgagctgcagtgcctggatgctcctgtgctgagccaggctgagtgtgaagcctcctaccctggaaagattaccaacaacatgttctgtgtgggcttcctcgagggaggcaaggattcctgccaggtgatttgaccccttcccatgctgaggctcccactgataaccaggccccaccagggaaaatgatttgaactcccaaggtggcggggctgaggaggctccctgcagtgccccatggagaagtgaggaagactcctttgggctgcatcctgtctgcttaggaagaacagagaatgggccaccgtgagaaggacgtggagccacagagctggctggaaagggctcttttaaggttcagagcaaatgtaggtgtattcctcctccatctctctcttcatacaacttgtcccttctcccccccagggtgattctggtggccctgtggtctccaatggagagctccaaggaattgtctcctggggctatggctgtgcccagaagaacaggcctggagtctacaccaaggtctacaactatgtggactggattaaggacaccatagctgccaacagctaaagcccctggtccctctgcagtctctataccaataaagtgaccctgctctcac

SEQ ID NO: 984 - DNA, 224290 bp, Homo sapiens
ccggtcccttggcgacgggtcttgcatgtgacactcttgccctctagtgcctcaccagcttggtagcagtttgatggctaatattaataagatgttacataacatgagagtactgggccaggactggtgttgctaccacttgtaaagtcaaaaagcctgagccgatggtaacgagtggtactgtttccgtttcttttccatctattgcaactttctcaagcattttcagctctgaactttaattccaggtaagtgtatttatttatttatactgtgcattaatgcctcactcataaatgtaggggcttttaagagataacaactttgctttcaaataatctaaaaatttcaagattgaacaagtgcttcattttattcttgaagaagaaatatagagtattttgattaaattaagtgaaacaaaggaccgtctcattcagggatgattttaaagcttccctttcataagattatggtactaaagaaatgacctcttgtaattgtttaagatattcaccaacttataatgattctgaagtagatctgtttaacagaacacatgtctgttgccttgacagaattttgtaaggaatatcagagactttaaactacctgcctatctacacagtaatgatcctcaaaaggctttctatttgatgcagtttatagacattatttaaaactatacaattaataaaattaaatggaaatggaaagaatcaatctaggtatcaaatacagaaactttaaatttaaagaaaacagatatatcttctatttaatatatccattttgtgggggcaggtaaaagcaaagttacatctttaaggggtttactcagatcctttttcaaatagtttttctaatagctggatactgtttaagcatcagagttatttaatgtcgaaaatgtattagtatctatattctttataaacatattgaaatatagcaacatgtaatctggaagagtttagaagaaaacccttctagacaatgcaaacagctacattcttaatacatttgtattaaattaaaatacaaatcaaatattgagatgtgtgcaactgatctgggacacacactttttttttgttttttttttttgcccttagaaaatttcatgttatcaactactgagcaatgctgttcaccaccagagagcaggatgatatggcagagaaactctagaatatccgatattcagctgaagggaatttttttccctttttcttcatccataccttcctatcaatattatatttaagatggagatttcaaatataagtttgaaggaggctcctttttaaaatagtactgaacatataaagaggcttgcctaagataagctcttttttttctttctctggttaacacagtatctaccatttctaattttgttatcatttttctttatcatcttgatggtaaaacagaagatttgtttctttgtgtaaataatgttaattttgagcttgtcacatgagttaattttcttcatagtctttaaaatgaagaattcttacattactaaaatgttttagataaaataaaacttttatctctttctggagatatttgttatagtttagtttggtggagttatatataccctctttttaaattaattttcttgagaaaagcattatttctgaacattgaggcaaatattaatttttggtgtaactgaaaagtttgttaaaaaatatatagtagaagagataatcaggcattggagattctttttctaaaccatatattctgctaaagaagttattataagctaaaatgtaaatatgtaattgtctacctgtcatttcaaaattttaaaactgtaaagaaattacaattttttttcttttaatcttgggactctgattatatgacttccttgaaacctgattgagtttcagctgctttttggtgattagagccttaaaagtgcatttgttaagatgcaaaatatatttttttaaactatatgtaaatactttgtgatttatatacactataaaatcagggaaattgaattaaggataaaaacactattctcaactaaatgaatgccttgaatttctaattgcttaacagttctgacagtaagggaaaacagtagaagtttactttccctgtgctgtgtctattataaatgagcattcacactgaaatgcatgaactctgaacacctgtccagattaggaatgctgccaggccacaaaagtaacgacctacattataaagataattagtctgaacaatcctcaaaactatttcatgactgaagtttctcgtaaaggggtgattttaatatttcttggtttgtctgtttgtttatagtaaaaaactatactcttagatacctggatatcacagtgagtgatttattctttcatgttactctaaacattttcatcgatttcatgtaagttacaggacaagaaaaaaaaagtagtcaggacctactacaattaattaatgtctataagaaattatttccccaaatcttctacaaattactgagggctataattcttgattacctgttgccaaataagagcttaaaaatcaattattgcagtcctatcctaaaacctttaagcatctcaattatgggtatccattttacatgtgtttcattgctgaattttttttttcattaaaatatttgaaaataacatgaaagtagacctaaattctaggactggctctgccaagacaggagtggccttgaacagctcccttgctggctctggggcttggtttcttcacctgaaaaatgaggattccagagacccttttttatcctgtttgttcaacattttagaaattgatctggaggccaggacgaagatagatgagaaaacatcagtgaataatacaaaatttaacttggtgataagtactattgtctagatttctgctaagtagagatgttacagtttttactcatagaatagttaccttgtaccaggcactgttctactttacatattaatttttagctcatataatcttcacaaagattatttaaggtaaatattattcctgtttcacaaatgaggaaattgaggcactgagcggttacctacctgcctaagatcacatccctggcaagtgctgaagctggtatgcagtttgagtccggctccagcacacattcctttaaccgttatactacattgtctctctataggtttcaaatatttgttcttgatatgcctcttgatggaacagaggtaatccatataccactccaacaatttccatcacttcccttacatatgaaatactcattcattcacccaggaggtatttactaagcatctacttttgcaccaggcataaaggagtccacaggacaattaaatgtggtgccttccctagctaagtatatacagtctagttcaggtgatttctttctcctcttttgctactgctgttaggttgagtctcacttgttctaaaatgtgcccaaggtaacagaagaataatttacctgacgcctttattgatgtgtccatagaatagagagtaatagaaccttcaacctcctcaagactccctatatcatattttttcattattcgtttctactctttttgcatcatcttctctctgcagattggctgtctttccttatctggttcatgtaacctgccctaaaacatagccaacactgatctgtaactttacatctaatggtccaggcaaccaatgagaggccaggttaacactctcttgttcccatgagtctaatgaaggacaaagaaaaggtttggattagaccctaaaagctgcattgtcagcactcacatatgtcatatgtgagcatgtgtgacagaatatgtcagcgtattttgatgcatgcattctggtccaatcttagagggtaaaggcagacattttcccccttaagtcatatagggcagaataaacagcaaacagcagtggggtagttttcttctcttgcatcactggatggcataacactgagggaggtgaataaaacatattcttctcttcataatttctaatacaaagatggagggagaatgataatagaaagtcattttccatttaatgtaccaaacaaagctaatgccctcaagtgcagcttttctcccatccatcttttaaaaattgcagttctagagacagagtgtattcttggtcatactccatgtaaatcagcttcttacttgcctaccacagcagggtttaattaacatgacacaatttcacacattctttcccaaagaaaagcttgcccttgtcaatttttattattattactaaattacttttagcaagtccatgtaacatatttgaggcctcccactgcatttttcaacattataaaatatagttttatagttcattcctttttcagaaaaaggaatattgtcaggatcttttaaatatctttcatttatgttagaacctgaagctctttagttattaatactcattttccagatggtaatcttttttcacttttcttgtactgccaactttaacatgattctatttcatttagaaattgatttttactttgggatgatggtgggtgttagtggaagagaaaagataggttacattgacaagcaggcacttccccttgcagatattgcaatactttgcagaatatatgtttgtatatattgagttctttcactatgttatggaattgtctgtgattccaaaaactaattgcttcttctgccttttgttaatggtaaataattaatggttaatatttgcttggtggagtctttttaaaaacagatgcattgcaaagcaactctattcatgctgaattctgaaaaatctcagaatggaaaaaataagtaattgagtaaatttcagtgaaaagcacattctggatatgcctgatttatggctctgatcaaggtggtcactgctattcacaatgtttatattattgccttgactgtttgaggccagtgtgactgatgaaggtagctgttcatagaagatggtttgacttaaatactgccctagtttgtgagtgccagctgctatttgtaaaatttagtagaggccttttttcactcattcaacaaatattcaatgggctattctcacttcaagtactctattagacattaaaaatatagaagtgaacaggacaagtacttacagatgcttccaagctatggagaaaaattgcataactaattataacagaaaatcacataactaattataactttggaacatactacagaggtaaagtagagagtgatgtgagaatgtgtaacagggaggcctgacagataagggggatcagggaagacttttgtgaggcagggatatatatacttagaaccataggatttggaagatgaaaccagatggggaagtggagaaaaaactttcagacaaaggtagcagcatgtggaaagaccctgagacagaaaagagattatctcttttgggaactgaaagaggacccacttgcctggaacttagaagggagagcatcatctaaccaggcctgagagataaaagtgggaagcataccacacagggtcttgtgggacatgtacaagaatatgaattttaaccagcaagtaaaataagcaatcattgacaggatctcagctggaaagaagtaacagagttccactttgatgctgcattgagaaaatggtagaaggagccaagaacatttgtggtgagattagttgctgcaagtaaaagaaggtgttaaggatgcacgtaggtgattgtgggaccatgaggatggttttagcggaaagatcataaattcagttttagacaggttaagtttgcttgtgacatgattctagtggagccaaatagtggctggaatataataagaaagggcacagtctatgtgagttgttgttgctattatatcaagttgatagttcaatataaaatcctagagcttagaggaaggaggtctgagttatgaatgaacattcagaatttactagagtgtagatgataatgaaaaccaagaagtatatgagctcatctaaggaaagggggaggggtgaaaagaagcccaaggacatggtgctggttatgcctctgattgagcctctttctttctttcttctaagatccatccgactttagatctctgcactaagggtgggcttatgtgcttcccacaactctacttaagctaaaatgctcatagctatccctttatgaacccttagtgtactttcattggtcatcttcaggatatttccctcatttcctgtgttatttctattatcatcatcatagcagataaattttgtttgttcattgtatgtgccaaacactattataagagtttggtttttgttgttgcttttgagacaggattttactctgtcgcccaggctggagggcagtggtgtgatcatggctcactgcagcctccacctcccaggctcaagcgatccaaccacttcagcctcccaagtagctgggaccacctgccaccatgtccaactaatttatatatatatttatatatttttatatatatatatatttatatatatatatatttatatatatataaaattttgtatattttttgtagagatggggtttcgctgtgttgcccaggctggtctccacccctgagctcaagtgatctgcccacctcagcctcccctcgtgctgggattataggggtgagcccctgcacccggcctctaagagctttaaccctcattaaaatccccttaggagatatcatagtagcccattttcttagaaggaaactgcagcatctaaagataatagctgcccaatatgcatttcctacttgttcctagcatggaaggatcgtgttgcagttatcttcccaggtgtatggtatctttgatgcaggctgttggagttcatatttcagttctacctctactagctgtgacatcatgggcaggttacttcacctctaaagggtccaacacaatttcagtacctatgtaaatgtttattaatattagctgcattactattgttattctatatcttcccatatcatattatttccttcagggtgccttataggaaatcttgatgatgtgttgacatttataactgatccaactttgtaactttctcgaacctaactatttcagaatgcctgtctaagtgatctgttgattttcaaaatttaaaatacagtttcctgatcagtcagcatagtcctcatcataggttgaattcggagcagaattcaaccacaactgtcagttctgtactgctgatcaagacagttgtgtctgtgggaactctctgacatgcaggctagtgtgcttgttctgtacttattcagagtaccctactgaccatgcaaaagtcttcaattttctatgtatttttgtgcaagcatttcacgaacatattcatcactatactgaaatgtttacatgttgatcttgttggcctttaaaagtgttttcatctcatttctttttgaaaaatttgaaaaattactgggaaaaaacatgagccctatgcccttggaaatttcagtctaacaaggaagacagacattagacaaataatattgttaataatatttcataagagttatgataaagtctccaaagggagcctcatctaaaggggaagaatacagttggtcagcaaaggcttccctgaggaattgggtttttgtagcacattcagacgtgcctgtaacctgtcaattccaaagattttcttgacattttgtatttgtctacatccaactatgttatataacattgtgattttgttatctaatcatgtataacttagtccatctatctatctgaatctgaagtgtgcatcactgagtcaagccaatttcccctcttagttttatgtttctattatactggcatctttatcttctagtccccaagactgctacctcccccaaccataatttaacagtaagcatgttttttttcttctttcttcccaaatatctctcatttccattctctctcaaaaccaccttagtctggacctataccacctcacacatggattacagcagcagccccttagctgggactgtcttgactctgcctacttcttcactctgcacagtgtggcatgttctctctctgttcatattactgctgttcatcattctgggtgtcactactacactaatcatctgtaaacactgtctttatcaaatccctctgttcaaatgcacccaatgctctttattttcaagctcatactcttgtacttcacaatcactttcaaggacattcattaatctgcaccactcttttaatcaaatattatttccattttcaaccccaaacatagtatcctatattttagttaatttcactctgagctaagcacattgtaaccatttcatttcttcaaccttgccagggagttttgcctgacatgttgtccccatcctcatatccaaacccagtgcatcatggcatgtcactttcaagcaccatgtctcttagaaactgccactgactttactaagcttcactaatctctctctctttctctctgtctctctctctctcttctgaaacctgtaacagatagtctatactgcataaatcactatttattatgtacaacatactgttggctgctgtctcacaagtctcatttcccttaatagagtccattatctaggggaaaggattattcctaatatcctaatatacttccgtggtgtccacagtatttactacagcactaattccaaagtaggtgttcagtaaatacctgatcactaattgcataatgataagtatttttggtgggtgaaggttttatctaccatagatattatgatattaaatttatcccatgttgggatgctatgattacattaacttaacattgaatgaaatagttatttgtaacttcaaaagataagttaaagcattagaatacagtaaaagtgtcaaattaacctacaggtgtaagatgccattgtattccattaattccacaaaaagtcattgctcctggcacaagtggtgcaatgataggcaaaagaaaggtactatctctaccctcttggagcttccaggcatacagaaagtctgactttaaacaaaattttaattatggcaataagtacaaaggagatgctcttttcacaaagaccatgtatacccactggtcttaccaagtttgaaaagtcagagaaggcaccacagggcaattgtggcgaggagcttaattttccatattcatccatctgcatgatgcctcacaagtgaagggctcaggtgaagtctgtaactttgcctttgcctactgctacggtgccaccttccacaggaggagtgacagcaacaggtcagtccatcctgaagttttcagagctaacagaaacatggaagagaatgggaagtagctgtccttggatgagtttgtagtatgaatagaaagctctgagaatctgcaccagagactgaagttggcatggcaaagtgagatgtgcaattgaaaaaggtttgcagaaaacaggagaattttaatgtatgcatttaaatatgttagaccaattcctcagggacgtgcactggaattttttctttagcttcagaaggaaacttgaagagcttaatagaaaagaaatgtccttcagcattttataatggcttacagagaaaataactttgatagattcctaatatctgtcctaaacagtgagagcaaatactcttcaccactctgcctcatcacagataagaattgtataagttacatgcctttcacttttgacaaaggggacaaattgtaaaatgctgctatctaaaatggaaaatgtagcaatacattttatgtctagtcaaaaacacctcacaggtaaaattgaaacgtagaaatgggaggatatgagattttgtattctgctgttatgctccagaatattatagtcataagaacgtacataactgtaaaagcgcaattacttatcaaaatgaaataactataattacaatgaaaactctgttgtccaggtaaatttttatttgcttaaatatcatctgtatctataccagagcatttaaaagagacctcacatggcatgccaagttcttgtccccctttctctgcagtgtttgtaagatttgtcccttccctacaattctccctcacctatgatgattaacagtttacgactacattgtgagaaatgagactgcactggcgtgccagatcaactctgtaagattgctctatgatattctccatgttattaattcttgtcccagaaaaatctgttatgttatccccctaatcaagaaagttgtgtgtctctaacagaatatcacagactggataatttataaacattaacaatttatatggctcacagttctggagatttggaagtctaagagcatggtgctggcatctggtgagggccttcttactgtgtcatctcatggtggaaggttgaagggcaagacagcatgcacaaaggggcaagagagcaagagccagccaaacttgcttttatgacactcttgagataagtaacctgctcccaagataatgacatttatctattcatgagggcagacccctcatgacctactcacttcttcttaggccccacctcccaacactgttgcattgggaattaaatttccagcacacaaactttggcggacacatacaaaccataagatctccctacaatctttcacaacctctgtactctcaagtcttagcataatctgggttacccatacatagtcaaatttattttttaagtatttctcactctttcctcccactcattattcatcatccttacccaatattgtgctcattcctgcctctgtaacattccctctatctcaaatgtctcttcaaattactcccatccttcaaggctctacccaaatcctactccacagtacagcctcaccaccccctggagcattccacagactcccccacttgccatggtctctttcttctctcatcctgttatagtcattgtctctaatccacaaccctcacattattatcattcttgtcactatctctgctttataatttagaacattttaaataaattcagtctgctgaacatttatattttaaatagcatgagagctaccccataaatgtttgaatgcatgacatatataccctaaatattttaatgaatgaactacaatatataatttaaaagataaataacacatttatcctgtaaatagaatataccataaatatcctacaattctattctagaatgttatattattcataaagataaacatattgttcaaaatattgttcattgtttatgtcatagaattttggaagcagaatgttattcgtgaacttcatcattttacttggtacagaggcccaaatgacacaataagtaagaagcagatgtgcgatagactctaatcttatgacaaacactaaatacagtatttttcacctgtgcttgttgttgtaccagctagcttttagcctgccttatgtagaatcacaggacctgtcttaatttttttatgttccattataatttcttgcaaagttccaggaccataaaactctaataaggttttgctctaagaagcacccaggaattccagagggggaaggcaagatggccaactagatgcagcaaagaagtgctactcccacggagaaaaaccaagggtttgagtaaatcaacataatttggacagatctctagaaagaaaatgcttaaagtagatggagatgcaatgcagatgctgaggctgagaagggagaaggcaggcacagggtactggaggcagggctagtccctggccctcaacagctccgggggaataggttcatgatgggactgtgggactgcccaccctcaccatgtgcctatgggatcctggcttagagggccccgcatcccccatggacacttgatctgacaaggggatctgattggagagtagataaagacagagcttcatccagaatggaacaggagcctttgtacatggtgcagctctggcagaacatggtaataggtgtccataacccaggtctctccatctccctccaaaaagctctagccacagctgaccactaggccagaagaaagtagagctgacttccctgtggaactggatcatgtctgttctgcaggccttccagcctgccagcccctctcagggccacaccctagcagccctgcaggaacatatgcacagtacagcctctgctgcccagcctgggtgccttgctccacctgattatgttcctcgtggcttgggagcactttggattcctcagagcacccagaatccaactccaagtacctgaaggatggagccccaattccatccaagtgcccgagggctgcagcagccacctcaggaatgccaagccaagttctgtggctggcactcaagtgggagaggagctcacactctcaaagcactgagaggggtgagatgcctattcatgggctggagtgggagggggcatgcctccctccacaggatttgccaggaaaggttgtctcccatctacctgctgcaacttcggaccagggagccctgcagcacagacacctaacaaaagaaatgcagacgcactgtcagtgatcagagggactcccccaaggtccaagagtggacatggtgaggaggtcacctctctccctgcccactgcagagcacagctgcaaatgtgagaaatacagaggagccatgcagctagataagaggctatctactgcccattactcttcagcatcatctactggatcccagcccaaactaccacgccaaaaatattttgctactatacacccctgtgaaaccaagggcaagaattcagccacaaataaaggccctatagagaggcttgggcatgtgaaaacatccagaaacaaatccaactgaagtactcaaattacgtcattgttaaagaaacactggacttcttagatgcgaaagaatcatggtaagacctctggcaatttaaaaagtcagagtgtctcctcatctccagatgaatccactagctccccagcagtggttctcaaccagtctgaaatgactgaaatgacagacatattatttagaatctggatggcaagaaaggttgagattcagaagaaaattgaaacccaattcaaggaatttatttatactatccaagagatgaaatatgaaatatccattttaaaaacgaactaaactgaactactagagctgaaaaattcagtataagaatttcataatacaattagaagtattaacagcagaatagaccaaactgggaaaagaacttcagagcttgaagactggctcttcgggccaactcaactcagacaaaactaaagaaaaataattgttagaaatgaacaaaacctctgagaaatatgggttatgtaaagacaccaaatttatgattcattggcattcttgagacagaataagcaactgggaaaatatatttgagtatatttccctaatcacactagagaggttgagttgcaaattcaagaaatacagagaacctaggctgcatactatatgagataaccatccttaaggcacacagtcatcagattcaccaaggtcaatgcaaaagaaaaaatcttaaaggcagctagagagaagaagggtcaagtcatgtacagagggaatcccattaagctagcagcacacctttcagcagaaacattacaaccagaagagattgagagcctatttttagcatttttaaaaacaaaatttccaaccaagaacttcatatggcaccaaactaagcttcttgggagaaacagatataaaatccttctcagataagcaaatgctgaatgaattcatttcaactagactggccttagaagaggttcttagggagtgctgaacatggaattgaaaagcaacacctgctaccccaaaaacacacttaagcacacagcctgcaggcactataatccacctagacaatcaagtcttcataacaaccagctaacaacatgatgacaggaccaaaatctcacagatccatactaatcctgaatgtaaatgagctaaatgccccacttaaaagacacagagtggcaagctagataaaaagacaagacccaaccatttgctgtcttcatgagaccaatttcacatgtaatggtacccacaggcgcaaagtaaaaggatggagaaagatctaccatacaaatggaaaatatacaaagatcaggagtggctattcttatattagataaaacaaacttcaaaccaataaaaatttaagaagacaaagaagggcaatacataacaataaagagtacaatccgacaacaagacttaactatcctaaatatatatacacccaacattggagcacctagattcatgaaacaaattcttcttcacccacaacaaaacttagacaactatacaataataatgggagatgtcaacaccccactcacaatgttagacagatactcaaggcagaaaactaataaactccggacttaaacttgacacctgaccaactagatctaatagatatctacagaactagtccacccaacaaccacaaaatacacatatttttcatctgcacataaaacatattctaagactgaccacatgtttgttcacgaaggaagtctcaataaattttaacaaactgaaatcataccaagaacattcaccaacctcagtgcaatttaaaaaatcaatatcaagaaggtctctcaaaactacacaattatatggaaattaaataacttgctcctgaataactccttggtgaacatcaaagttaaggcagaaaccaaaaaattctttgaaattaatgaaggcagggacacaacttaccaaaatctctgggatgcagctaagttagtgtaaagaagaaagattatagcattaaatgccttcatcaagaagttagaaagatctcaaattaacaatctacctttgtacctaagggaactaaaataaaggaacaaacatacccccacagctggcagaaaaaaataaataactaatattaaagaagaattaaatgaaattgagatgccaaaatccatataaaagaccaatgaaaccaagagttgtttcttagaaaaaaataaacacgaccgatagaccactagctagaataacaaagaaaaataaagagaatatccaaaaaagaacaatcaaaaatgacaaagataacattacaactaatcccacagaaatagaaatatccttaaaaatactatgaatatctctactcacatgaattagaaaatctagaggaaatggataaattcctggaaatgcaatctcccaaaactgaatcattaagagtttgaaactctgaaaagaccaatatcaagctctgaaactgaatcagtaataataataaaaaaaaaaaaccctacccaccaaaaaaagcactggagcagatggattcacagccgaattgtaccagacatactaaaatgaactggtaccaatcctactgaaattattccaaaaaattgaggagaaggggcttcttcctcacacattctgtgaagcaagcatcagcctgataccaaaatctggcagagacacaatgaagaaaaaaaacttaggccaatatctccgatgaacatagatgcagaaattctcaaccaaatactaggaaaacaaatccagcagcacatcaaaaatttaatatgccacaatcaagtcagctttatttctaggacgcaaggctatttcaacatatgcaaatcaataaatgtcatttaccacataaacagaattaaaagcaaagccatatgatcatctcaatagatgcagaaaagctttcaataaaattcaacataccttcatgataaaaacccttaacagtctaggcattaaaggaacatatcttaaaataataagagacatctatgacaaactcacagccaatgtcatactgaacaggcaaaagctggaaccactactcttgagaactggaatgagataaggatgcccaccctcaccactcctatagcactggaagtcctagccagagcaatcagacaagagaaagaaataaagcatccaaatagaaaaagaagtcaaactatctctctttgctgatgatatgattctatacctagaaaatgctaaagattctgccaaaaggtccctagaactgataaatgacttcaggaaagtttcaggatacaaaatcaatatacaaaaatcagtagtgttcctatacatatatcaataatgttaaagctgagagtccaatgaagaatacaatcccatgtacaatagccacaaataaaatgaaatatctaacaatacagctagccaaggaggtaaaagatctgtacaaggagaactaaaaaacactgatgaaataaatcaaagacaatacaaataaatgaaaatacttttcatgctcatggattagaagaatcagtatcattaaaatggccatactgcttaaagcaatttacagattcaacactactatcatattacaaatgctatttttaaataaatataaaaaaactgttctaaaattcacatgaaccaaaaaagagcccgaatagccaaagcaattctaagcaaaaagaacaaagccagaagcatcagactacctgacttcaaactatactacaaagctacagtaacccaaacagcatggtactggtacaaaagcagacacatagaccaatggaacacaatagaaaactcagaaataaagccacacacctacaatcatctgatctttggcaaggccaacaaaagcaagcaataggtaaagcactccctattcagtaaatggtgctgggataaatggctagccatatgcagaagaatgaaactggacccttaccttttaccatatacaaaaattaactcaaggtaatttgcctaggctgtaatcctaagcaaattaagtaagcaagttaattcaaatgcaggacatcaaactataaaaattttagaagtaaatctaagaaatactgtttatgatatcagccttggcaaagaatttttggctaagtccccaaaagcaattgcaatgaaaacaaaagttgactagtgggacctaattaaactaaagagcttctgaacagcagaagaaactatcagcagagtaaacagacaacctacagaatgggagaaaatattcacaaagtgtgcatccaacaaaggtctaatatccagagtctacaagaaacttaaatcaataagaaagaaacaaccaaccccctttaaaaacaggcaaaggacatgagcagatgtttcttcaaagaagcaatcaggcaagagaaagaaataaggcatctaaatagaaaaagaagtcaaattatctctctttgctgatgatatgattctatacctagaaaatgctaaatatcctgccaaaatagtctctttattaaaagaagacatacaagtagccaacaaacatgaaaaaatgttcatcatcactaatcatcagagaaatgcaaatcaacaccacagtgagatatcatctacaccagtcagaatggcaattagtaagaagttaaaagataacagatgctggtgaggctgcatagaaaagggaatgcttatacactgttggtgggaatgtaaacaaattcagccgctatggaaagaagtttggagatttctgaaagaacttaaaacagagctatcacttgaccacagattccattactgggtatatacccaaaggaaaataaatcattctactaaaaagatgcatacacttgtatgtttatcccagcactattcaaaatagtaagataaacaatcaaactagatgccaatcaagagtgaattggataaagaaaatgtggtacaaatacaccatggaatactatgtggccataaaaaagaatgaagtcatgtcttttgtagtaacatggatgtaactggaggacataatcctaaacaaattaactcaggaacagacaacaaaataccacatgttctcacttacaagtgggagctaaaccctgagcacacatggacatatacacaagaacaatagacactgtggactattagagggaggaagaaggaaggaggacatacacggtggaaaaactacctattgggtactgtgcttactgcctgggtgacgggatccataccgtaaatgtcagcatcccacagtatccccaggtagtaaacctgcatgtgtaccctctaaaataacggttgaatttttttaaaaggaaaagaattccttaggtgcccaggtaaatccaagcatggctgtacattattttggatttgactagccaggaaatatgtgtttgtttcccattagttcaactatctgagaaaaaatattgttcagttgacagagatatatacacagtttgcttaaccttcatgcactcaaaatactcttaacagtaaatctgtatcagtgtgctgtgataccagaggaagtgtaatcctaataaatgtagaacacccaaataaaaaaagaagcactcatgtttctttcttattatttttcaaagttactaaattttcaaaggttactaagacttgaaagggatttcaaattattgcacaacaaagtgtttcatgaagtctcagttgttttcattacatttttaaaaacatttttggagtagtttttcacataattactaaactcctcaaaaagcggaaatagaatggtatagaaagtgaatcaataggtaaatttgctcttctccaagagtatatggttcccaatggtctcacaccagatttgcagaaaccctgggaagtattttattcctcatattcatcttaccacatgactgttttgatttttggaaaatgcaactatgaaaatatgcagttctaaaataatgaattgcattgtgggaccatatatgcattttgaaagggttattttaatgagagcaattatcataaggttgtttctctaatgaatgtaaaatgtgtatacaatgataaaattgactgtgccatcgactttgcagaaaagaaaaacacatgttttaattatggcataaacattcagtacctgtgattaaaaacaaacagcttgagtatgtattacataatgtatagccagatggcaagaaatggcagtgtatgacttaggtgacctctccgtggtctttgttgtatagtatctacagagtttgatgcaaagcacagtgaatatcatgaaattttctgttagcccaaagtcttttttttactaggaatagagggctcaatggaccccttttcctctttctaccagtcccatgtcctcacacagatctgggagaagaaaagggagggcttcgaatttactatacaccagttcatctgccaagtactctgccacttatgctagtcaacaagataaaaacttgcttattttaatgctgcaaactgactgttttatattcttttctatttttcagactgtattttctgtgagtcctgatcaagtgatacaaatgagctgcaatggtgacataaactcttgacagagattggaaaagtagctggaacaccatcttttcttttaactttttatggtgcttctgttggcatagttggggaaagcacctacaacatgagttttatcatgaagcttcacagacactttcaaagaacagtcattctgcttgccactttttgtatggtgagcattatcatttctgcttactacctgtacagtggctacaaacaggaaaatgaactctctgagacggcttcagaagttgactgtggcgacctccaacacctaccatatcaactaatggaagtgaaagcaatgaagctttttgatgcctcaaggacagaccccacagtcctagtatttgtagagagccagtactcatctcttggtcaagacatcattatgattctagaatcaagtagattccagtatcacattgaaattgcccctggaaagggagatctcccagtgcttatagacaaaatgaaaggcaaatacattctcattatttatgagaatattttaaagtatataaatatggattcctggaatcgaagccttctagataaatactgtgtagaatatggtgtgggtgtcattggattccacaaaactagtgagaagagtgtacagagctttcagttaaaaggtttccctttttccatatatggaaatcttgcagtaaaagattgttgtattaatcctcattctccattgattcgtgtgaccaaatcttccaagcttgaaaaaggttctttacctggaactgactggacagtttttcagattaatcattcagcctatcaaccagtaatatttgccaaagtaaagaccccagaaaacctttctccttccatctctaaaggtgctttttatgccactattatacatgacctggggcttcatgatggaattcaaagggttctttttggcaacaacttgaacttttggctgcacaagctcatcttcatagatgccatctccttcttatcagggaagaggctgacattgtccttggacaggtacattcttgtggatattgatgatatatttgtgggaaaagagggaacaagaatgaacaccaatgatgtaaaggtaaggctctattttctcaagtttcaaagttcagttcatcttccagcagggatacaactatcccagtttgtactacaactgggttacccaggacatgggatttactgggaaagtctgggcaatctaggattatcgctcaccctaaatcaactaagaagattatgtatttctatctgaatcaagaaaaataaagattttactaaaagattgagtgtggcaggatcctgaaatggttttctacatgtatttacaactagagtagaagtcatttcgtttaattactttccagaaactatctacctcaaaaaaaagctattactaatctcagacttagctcatttaaatatgaaattaaagtgaatttgtcttaatgataataaatatttccacaaatttcaagaattacagatctcattgtagcaagttcagatacttttggaagtcaaatatgcagtgcattttctcttatcatatttttctgaaactgaaaatcagtactactaaatatgaagatcaatgactgtataagcatatttattcacatttaaacatgaggatttaacttgatttcagcgaacacttctgacacatatatgaagccaatcatgccaaatttaaattgtattacatttcttattgtgtaaaactgctgcccttaaacagaaaacaattatttgaaatagtttgtcattattatgagttgattgtgttacataaacagctgattgtttactattaaaaaattttaaaattaaagttatctacatttgtcttagtttccaattcgaaatgtcataggattctatctctgttatactatgtattgatttctcataaaagtgagacttttgatacatagtttttattctacagttttgaccttttggtagaatatctagaatcaaatcagagagcaaaaaatacatcttgaaaactttgttcttttctctagtcactaagcatctggcaaataatagtaatgttcatcacactagttaagtgggctaagaataccagaaggaccattaaatgttactgtaagagagtgtgaagactgaaaagaaaaaaaacttccatattcttggcactattttagtctcttccttttagctaaacagaaattaataaagaagctgtatttaagtttccattaagtctttgtacttacttttgaaaatatagctaaattaaaaccaagctggtagtttaagcatttattaggtgtttgaagattacaagcaatatataattcttccattttttttccatttcaaatgattttggtgagaaatgttttcaatatgaatatatttctgaagtgaaattgtttgaaactgtcaaatatatattgttatagaattttaaaatatggtaaataaatccctgagttttgtatgtagccccctgtttcccctaatattatacaaaatacaaaatgccatttgtgctccagaagttaagccagttttcaggggtatgaaaaattagaggcttattgaacacattaaagaaaaatttggcatgtctactttatgaactgctcatatttagatagaaatatattttctaaactaactaaatgcttttttaaaaaatgtgttttgaataatctgggttttttaattacttctaaattgcatctgtgattgtgtctcaaaacactaatttactacagtcaattgccctgagagtataaacagtcattcatgtattcattctgtaactagttattaagcgtgtactacatgtgaagcactttttggaacttacagatagaatcttgaactgtagtccattccagagaagaggggcaggggagagtagagtcataggaaagcacattgtgctgagcatctatccgttcagttcttgatatggctatatcccattccagacatagaggcaggctttagggatacaatgataaagtgggggtgataaataggtaaatagcttgcaacatggtaagcacaatagcaaacatatcgacacagtttcatataaattatgttgtgggaaacactacagtgtgtgctgtgtacctgtaacttaagtatgtacttaagtatgtacttaagcatgtaggacagagttcaaaggcaagactagattgatgtgatgatttggaaagatgtagcagtaattcagacaaagacagcaatttcttgaaaccaggaaattggagtaagaatggagaaggaaggaccaaattaagatctatttaggaagtaaaattgaacaacttagtaattggctgaatggagatgaaagagaatataatcatgacattagaatttgtcatgaaagagaatataaggatgactttaggatttttggcataggttgataattgttgatgatgtgaacaacagtaagtaagaggatcatagtgaagatcattaaaggtcataataaaaatttcagttttattaaagtccatgtgggatgcagagcatttcacaggtagttgcctcacaggaaaagtctgggtaggaaatacagatttcaaattcatcatcctatagggaatcattcaccacatgaaagtgtgtgagctcagccagggaaaaaatttagagtgataagagaagatgatcaaatgtagaatattgaggaaaatcatcatttagaagacaagtagagggaaatatcccttgaataagagtttgaaagaacagtcagagaccaggaagctgagatgctatagcttcagaaaaagtgtgatcagcagtataaaacccaacagcagggcccactgggctaaggactggagagtctcctttgggaaaagacaaagatcactggggactcttgcataatctatgtgaatggaatgatagagaccgaagcccatttgcagtaagttggagtcaggagttgactaagggggtcaagatgtgaagaaagagagtgtagagcactcagtggagacatttttgtataaaggaaaaaagagaaattatacagtagctagagggtagactggttctaggaagaccaaccgtcctggtttgtccaggactgagagtatttgttgctaaaacgtagagtccaagagttagatagggtgacctaactaaatcagataaggaagaataatcaaaaatcatgaggtctaaaaaaatcataaattttgtgattaagagtatataattagtataaatgtttaaatcaattattttatttaattattaccacttatgagcaaatattatattttccctatttgaagtattgggaaaatttaaaagaatgtgagaaaatcaaaagttacataaactgttatgtacaaaattggaaggagagtgcaagacataaattttaactagcaaactaatcactgcatggatgttattttttttcttatgtggaatagaaaatgtgcttccttatttaatgggaagatttgaatagcaatgcaatatcagctttacccacctagatgttgaataatatgagtatattttaaagatcctcaaagccacagaagaaactgtgacatggcacaaagtgtttcattctttgtgccacaaaaagacaaaaaaaaaaaaaaaacagacctaagttgaggtctttgtttgtctaggaatatgcaagctacaagccatagcctgtaaagaaccaaagaagaaaattgtttagataattcaaatattcctttaaaaaggcaggacaaatttcagtgaaattgaagtcaggaaaagtgtgtgtgtgtgtgtgtgtgtgtgtgtgtgtgtgtgtgtgcgcgcgcgcgcacgcatgcatgcaaacgtgttccattggactattggatgagttttagtgacgttcaaaatttcaagttccttgtgatctacaacctaccctcaaacttcccgactaagggttttgggagagagaaagtgatgtttctacaattaaaaaaagcttctaccattaaagcatttgttttacatgaaagcacttcatgacccagtgaacactaataacccatgtgatcttttaggcgcattaactcactcttgttgtaagatccattatacctttagacctaccatttcatataacatttatctcccaagacatctgagaagtcaaatgagaagattctggagaaggtggtctttcagggttttactgaactccttgcagttgaatactctcaatgcataaaagaggttacatatcactccctcctgcatctctcccttcctctctctctttgatttctgtaataggtacacattcctttcaaactttgagaaaattcctaacattcttcggaaaatgaagaacccgcccagtcacatctgagcttactgaagaggtaactgtggctcctcctggagcatcttgtacttctttctggaggtactcaacagccactttccttttttaactaccccagacctttctcactattttcttacatttcaatataccataacttgtctatttgtggattagcccttaaaaaatctacatttttaaagtggccccagaagaaagggaagttcttaaatttttaatacaatgtcatgagtggctatatcattattttcctctctaatggaagatcccagagtacctagagaaaagaaagtgctgaaaatagaagtgggaagctagaaaactgtgaaaaataagaggtatcaagctcagaagataaactcagctgacttttcagtcttgcttggggctgactgtgggaagctctaattggaatgtaaaggtgcgctctgtgctgcttgacttcaccacgaatattcaccaccccagctaagggaagccagaggcttcataaaatcactaaaaaataacaacataccaaatattgggaggaggaggaaaacacaactgcaatcaattattctgtcataagtacacataaaagggtagcaaaaatttctccagacagttcactattcatgtgctctgtatgaatgtcaagatctgtacattgtacatagtattaatgttttgtcatttttctcctaaactcatatttcttgagttcctttccattatatctgatgtttcttatctcttatttactgatattcatttaattttattatgctatagaagcatgtatctgcttgatcccattacttcaaatttgctagatttactttataactggatacagtatgcctcatgtacttgataggaacatatattatctaatcaaggtataccaacacaaccttgttaactacatttttcaaatctgtcttcttactgtattcttttttggggggtgagggaatggaatggtatccctgatgctaccaaaagagttatgtttaattttccaactctgatggttgattgtaaatatttccttgttctgaaaattattgccttctatattttgaagctatgttaagtgcacatattttgaaattgtattttaatatgttttttcattctatgttatctttttaactttattaatgttgttttgcctttgttttgcttaatgctaatacagctataccagctttcttttgattactatttgagaaatatatcttactccttttttatatatttttaatctctctcctgtctttgcactgtaaattagctttgaaaacagctcctaggtgaactttgcttttggtctactctgtcaatatttgtcttttaattaacaagatcaatctacatatagttaattggattatcaatgtatatggatttatttcagctactttattttgtgctttatatttgccccacttgttatatttcttctcttctttctctctcttcctttttaccttcatttgaattgtcagtttctttcttttttctatccattcctggtttaaatgaatgtattttatctctttttttttagtagtttctccaaaaatttaaacacatgcactaaacaagtgccaatatcttcatacctcagtcaaaaggtacaaagttctttatctccaataatgctctctctcctttggcggttgggttattctggttctagatgttaatgttgctgtttaacaccggatattaggcactgttgtttttactaccatcaaagttttattagatttgccagatttctactgtttcctttgccaactgttcaccttttctcatccgatgtgattctcagcttctacaccttacccctttctgtaaagagcagacagtcatgccattgacacgtaattttgatcatgacccccctctgctcaaaaccctccagcaacttccagtgtctttatctctgctacacgcccagctccttttccctcacgctactgcagcctctctagtatctttgctgttccttgctcctgtttcagaattttgcacttgctgttctttctccctaaagtgtccttcccccagattggtgcatggctctcttctttgcttcctttagatctttactcaaatgttactttctcagtgaagtcttctctgaccattctctttaaagttgcaacctctaaatctcccatctttccctgagagtgttttgttctggcacttatgatcaccaatgatgtgctaaaactggctcacattggcttacaaggtcaattttgtgcatctccttctagctttatggaaggaatatttacactgtaaaatagacaaatgtgacaaatctgggctttttattcacacagacccagttgttaaaggcttcacagcatgctaccagacataccatgtattttactaatttattaggttggtgcaaaaataattgtggtttttgccactactttgttatttggactattaaaatgtaagctttattagggcaagatttttttcatctattttgttcacggatgtatctccagcacagagaaatgtgcctggctcagtatatatttgttggatgaatgaattgcattctttctgaagtatatcctttagacatgataaaagaaaaacatcagctgaattaaatttaaaggagtttaattgagcaatgaacaattcatgaatcaggcagcctcccgagccagagtaggttcagagactccagcgcagccacatggtggaagaagatttatgaacagaaaaaggaaagtgacatacagaaaacagaagtgaggacagaaacagctggattggttacaggttagtgtttgccttatttgaatataatttgaacacaactgactggccaaaacacagtgattggcacaagtgtagactacggtctgtttacacctccacttgttatagctcacaatgtacagaaaaacctttaggctgaactgaaattatgtaaggaggtggctttagtccaaactttattttaaagacttccttcaatgagaatctattcatggtaaaccttctcagattttatgcattgtaaatgtctttattttccctcatccttaaaagatagtttggttgacttcacaatgcctaattaagttccctcatatatatccattgctgctcacactgggaagattggtcctccctggaagtcacctaaacatttttggtaatagaatgtccagttccactggtccctaatagttttatgattgtcacaatattaggcaatttgagaccattcttctctccctccctctccctcactctctctctttgtttggtggaatacttacttatttctacatttgatataacgtgatcatattaaaaatacacaggaaaataaattactgtcaatattattatcacattcaaatagccatagtgtgctagcaactatacaactgtacagttattttaaggaaataattttataatttaacatggcgaaatcataaaatagattagcaaagggaaaaaacatttcatattcataatctatttacttttaatatattgtattaaatttgttgttacattgtgaaatggaatgtttctctactattaaggagtgatttgttatgcaatgacgttctaaaagaatgagttataaattatttaaagaaagcaaaatgctgttactgaacacatgaatatgtaaacaggatacttggtgactgattacattttttaaaggtctgatacagtctgggcacagtggctcatgcctgtaatcccagcactttgggaggccgaggtggtcagatgacctgaggtcaggagttcaagaccagcttgaccaacatggagaaaccccatctctactaaaaatacaaaattagccaggagtggtggcacactcctgtagtcccagctactccggaggctgaggcaggaaaatagcttgaacccgggaggtggaggttgcagtgagccgagatctcaccattgcactccagccccggcaacaagagtgaaactccgtttaaaaaaaaaaaaaaaaaggtctgatgcaatgaatccaacccacgcatgatacaggagggctgtcataaatggtaccaaagctcaaccagacaatgatgagttctacacactgtagtagcagaagaatacaagaggcaaattcagaacagagatttaggttctagagatattaagaaaattatgcacatttactttgttaaaataatgtcataagatttcaaaggatatgctgatgaataatgaaacacatttttgataaaggaaatcaaaaaccttggagaaaattgtacgatttgccagttactggattatgtccttctcttggttaagagaatttatttcttctaacattccatgtttctagaaaataaatcagcatgtaaaaaatcttttttgtatctctatgctggtgatttaaacctgtacagactgcagtaagttactcccaaaataggtaacacttactgagtatgtacgttgttttaagtgctttgcttcatcatttaattatcgtagaaatcctataaaacaaagattataagcagcatcattttacataaagaaactgaggctgatagattatgactaacttgcccaagatcttacaactagtaagtggcattcctagaatacaaaatgcagatctacctggctccaaaatctgagcttttccacctcatgtgcttcacagttatgagcttaacacaactggtgttaggtggtgtccataaaaatttcttcctaccaagctccaccttatggtaaattacatcctatcagattctgttatagtttgatgggttgtatctaaagctttgccctagatttaccgataagtctggaacaaaaattagtattagtcacttcttgaaatgtcttgggctgaaataaattttggatgaattagagtggcatagtgacagcatagtgacaggcccttctggcgctcaatcaattaaagaaccaaaattgcccataattctgataatctcactttttctatctgtatgtactcagattttaaagtctgtgtgatgttgtaaagtgctttatgaaggcattcctaacatttttttaaagcacacaaacaaaatagaaaaagtcaaggaaattctgacatattgtcacttagtctctgggaaacatgaattagtagctaaagcacttttttattcttaacttttataggcttccatgaataatgaaactggagactgaagtacaaaatggatcttaaaatcatgatgttaatataaaataaatgatgagatctacttgacatcatttataaactgtttataaccaaagaaatatagccaacttattaaacttctagataaactgaaatttttaaaattaaaattaaaatttacctataaaatacatattagaattttaccttaaaagattatatgctttctcattttaatattaatagttataatgattatacaggattattaatagttattagttacaccaattactaaaacagctatgtatggttttctattaatgccaaagcaaattaccaccaacttagtgtcttaaaacaacccaaatctgtcattttgcatttctgaaggtcagacatccaacatgggtcttactgagctaagttcaagatgtccacagggctgtgttcctttctggaggctctaggggagaacccatcaccttgctttttccatcttctagattccgcacacattccttggctcatattcccttccttcatcattaaagccagaaatactctctgtgccttatttcatggccacatctctctcaaactggaaaaggttctctgcttttaaggatccgtatggcccacctggataatccagaataatctccccatatcaaagtccttaacttaatcacatctgcaaaatctcttttgccatgtaatgttcacattcacaggttccagggattaggacatggatttcttggcgggggaggtaaaggagatattattctgtgtaccacaagctatgctcttcaggtaatcatgctacaattcttacaacgactcaactcccgcaagaaactctgctactctactactgttttcctcactgggaaatgaaatcttgatggcatatacatgctcaaacaattactctagatctctgagtcaacagtagttaactagggaaaattaaattattgtgctgttaaacgcttcatatcccttacacacaggaggttaaacatgggggagcaagtaactcttccttcacttagatgtcttaagaaatgtacctcaccaaagattgcttggttggagcagatgtgtgactatcatcaattcattactttaggagtttctaatatcatgtttctagaagtgcatcaattatgagactagagactgttttgaaagccagttgattaggactaccacatagtcacctaagcacagtttaccattttcattgttaccatttcattatacttttatttttctattttgttctctttgatttatgtttctgcatccacctcagtttcagtgcccttattgtattggcctttccccctttggaatttctattctaactaccccaacctaaaaacaacaatggtgttttatctgttcatcccttctgtctttatctcccctgctttgatatcctggtgcctggtgcagtaatgtacctttttccccccttcatacatagatctttattttatgtaacttcttgtctctattttcttctctgactatataaactgagtagaatcagatttctgggaaagaaaaatattgcgtgtagaaattagaccaacttgttgaggcactgaacaaagatctatcctcaaaaataataataataagttcttcactattcttttggattaaaatatatattttatatataacatattatatattatatatattatataatatattttatatattatatatattatataatatattttatatattatatatattatatattatattttatatattatatatcttatatattatattttatatattatacataatatattatatatattatatattatatatattatatattatatatattatatatattatatattatatatattatatatattatgtattatatatattatatatattatgtattatatatattatatatcatatatcatatgttatatattatatatcatatatcatatgttatatattatatatcatatatcatatgttatatattatatatcatatatcatatgttatatattatatatacattatatatgttatatattatatatacattatatatgttatatattatatatacattatatatgttatatattatatatacattatatataatatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatacattatatataacatgttatatattatatatatatatatagtgctagaacaacatataacagagtcatttttatctaagaatcctaagagacaaagtagttgagttcacagagaaagacaacttacttgatattcttgaataaatgaattcaagtggttttgacaataaaatgaagattagagttgctgccaatggggtaatgaatagttatatcctgccaaactcagatttctgatatgctgaaaaatacttctaggaaattttgtataacatttaacaaaaattatttgacaatattttcaggaaaaagacattataatgaaaacccattttaactctagtgtgattgctttaaaaaagtaagttaggttaatattcaaaggatctcgacataatttgctaatctgctctagaaatgcaataagtatttaaaggaagtaaagggagaaaatactttcccagtctatgtcatttcttatgtgatacagggacactgtcattgctctaactgaggggcaaatgaacaatggaaaactaaagacacatttttccttcttgctaggactgtcctgctagaagcatatctccaatagcattgtcatttgcactttgcaagaactaattagtactcagtcaccattctcaaagaagacacagctgctcattgtattcaaaaaagttatgtttacctaagtggaatctatctttaaggatgccagtggcaagaggctgttcatcaaacttcagaatagttcagagcctctgaagaggcctaggagggcctatgttcactgctccgtacttagaaattgacacaatgtcagtgtggagggtgggggtgatgggaggaagagcatcaggacaaatagctaatgcatgctgggcttaaaacctaggtgacggattgataggtgcagcaaaccaccacggcacatgtatacctatataacaaacctgcacgttctacacatgtatcctggaacttaaaataagtaaataaataaataaaaagaaaaaagaaaaaaaagaaaagaaattgacacaatttcagtgcaacatcctcaaaagcaaggaaagtctatgagagtaattaattatctttgttttcaagccatcagcagacttcagattgtttctctattgtaattgaatgtctctaaggagcaaagttattacttaattaaaactaatccttctggtcacttacatatgacatagtcaacagcttatacttgatctcttttttttttttttttttttttttgaggcagagtctcaccatgttgcccaggctgaacttgaactcccgggctcaagctcagccttccaagtagttaaaaccacaggcccatgccagcacacccaagtatacctgtacttttattgttgatgaacctaaaacacagatattactgggcaccagtgatgaatctactgttaacttgtaaatgaacagaaagcaaagtcctactgtattttttttaaagaaatggttcaagaattcgtcactagtttcttcttaatcattcttttactctgtgatgttcagatgcatttaatcacttatcaatacaagacaattttcatgagtttccaaaccacggaaaagccaagaaacatcactttaaatgtttgcttaaaaatgcagattccccaattccacactcaaagatttttgtcttggtagatcagggggaagtgaggggcccagatcacctagatgattctaatgcaggtagtagaaatgcacatttggggaaacataggtttaaatagactacatttgatattattgtaaaatatgaagacctgggtcctattattttttcctgtagaaagtatcttaaaatcatgttgtataaaaatatttaattttacatatataagcaaatatataatggaaagaggtcacaatagaattaatagttttgtgactgagtttaatctgatgctggaagagttcttacatttagttattttgaaccatgtaccaagacagtgtgataatattttggcaaatatgtgtacatgtgaaaactgcctatggagatcaatatagtgcattttacatgaagggacagaaacagaagattgaagaaagtaattccaataagtggatgacttgttagtattgcctagtaagaggacactggataattttgacaaagtaatgaaaggtacattgcttctgtgatctttcaggaacctgtgcatcagatcagtcagaagaaagattccagcagagaaggttatgatcaggaggtgtaagagttaggatagagaaatgggaattgttttcctaaaggggaaggaacagagagagagagaggttaattatacttcaggtttaattgaatgtgcttctaatgaaatagcaaataaattacaaaagagatctgaggttgaattatataggtgggatagagtaccccattaggtgatttttttaaatgttagcaagagaagtaattttgaatgaagaaattttaccttgggaagctttaaacattcgcctttgagaaactacaattagagtgagccctgtttggggtttttttgtctaaatgtccaaaatgaaaataaatttttattattttaaatatataaacaatccacgcactttgtaatgaaaataattaatatagaaaactacaaagaagaaagcaaaaagcaattctctcctcagtctctctacacgctggatttagtcaatctttaatgtttgcaaatctaataggtaaaattttttatttcattcattttttaattcttatttgtatttgtaagaaagagttaatatggtcacttatgtttattgtccatttgtattccccttttgagaattgtttcttgtcaatcgttttccattggagtgtttgtttttgaccagttattatttttcctcttatttcacactccataaatggaacagcatgttcctttgttgttatttaacctttatgtatttatattcccaggaagttttaattattacaaattaagtttaaaaagttttattaatatcatagagggggaaggctgatacaacctctttcaaaagataccaggttgtagcacctggtacagtgttcctgcagtgagcaacttactgaaatgtgtactctcagagctcatttctcccctgcaaagatggcaatgaaataagaatgcagcaaacctatgagtgtgaaagcactttacaaatcataaatctttatctctgggtttgtttcttttcctgggattagacaattagatttaatcattgctaaggtctcgaccagttctaactctgtgaaattctttaaaacattactaaggaaagcccagcaccaattgacttgagcagagtaattatatggtgaaatagggtgaacagaacactgcttctgagaattaggattcccatccttcctccacatggtatgctttacataacagccccagtgaatgcatgtgtgagaaggctggttggcctccctgacttctggtgaggcagagaattccaagactctctggtttccctgaataacattatccatctgttatataacttgtttaaaatattctgtaggtattcatatgattactccctacagtctattattttgatacagtccataagcttacttttaatttgaaacaaatttcccagcctgtggttcttatcaaatccgtcatctatgtgttcaaccctcaattctgtagacctcaaccattcttttttttttttttgtacactttaagttctagggtacatgtgcacaatgtgcaggtttgttacatatgtatacatgtgccatgatgctgtgctgcacccattaacttgtcatttacattaggtatatctcctaatgctatccctccccactccccccacctcatgacaggccccagtgtgtgatgttcccctccctgtgtccaagtgttctcattgttcaattcccacctatgactgagaacataaggtgtttggttttttgtccttgcgatagcttgctgagaatgatggtttccagcttcatccatgtccctacaaaggacatgaacttgttttttgtccttgcgatagtttgctgagaatgatggtttccagcttcatccatgtccctagaaaggacatgaacttatccttttttatggctgcatagtattccatggtgtatatgtgccacattttcttaatccagtctatcattgatggacatttgggttggttccaagtctttctattgtgaatattgccacaataaacatacgtgtgcatgtgtctttatagcagcatgatttataatcgttgacctcaaccattcttatcttgactttcatattttcttataacttttatttcagcttcaagggtacatgtgcaagtttgttatatggtatagtgcatgtcacaggggtttggtgtacagattatttcaccactcaggaaataagcataatacccaatagttagttttttgatcctcaccctcctcctaccctccaccctcaagtaggtgctgttgtctattgccttcttctttgctttcatatgtactcattgtttagctcccactaataagtgagaacatgcagtatttggctttctcttcctgcattagtttgcctaggataatggcctccagctccatccattggggtgttctacaaaggacatgacctagttctttttcatggctgcatgatattccatggcatatatttacattttcttcatccagtctactacttatgggaatctaggttgattctatgtctttactattgtgaatagtgctgccatgaacatgcacatgcatgtgtctttaaggtagaacaatttatattcctttgagtatatatccaataatacggttgcaatggtagttctattttaagttatttgagaaattgccaaactgctttccacagtggctgaactaattcacattcccactagcactgtatgtcatcttttcaacctcaccagcatcttttatttgttgactttttaagaatagccattctgactggtgtaagacggtatctcattgtggtttttatttgcatttctctaatgattagggatgttgaacattttttatatgaagatcagatggttgtaagtgtgaggctttatttctgggtgctctaacctgttccattggtttatatgtctgttttagtaccaataccatgctgtttgggttgctatagccttttagtattgtttgaagtcaggtaatgtgatacctccagctttgttctttttgcttaggattgctttggctattcaggcacttttttttgtttcatatgatttttagagttttttttctaattctgtgaagaatgtcattgatagtttgatagaaatagcactgaatctgtaaattgctttgggcaatatggcaattttaacaatattgattcttcctattcatgagcacggaatgctattcctttctttgtgttgtttttggtttctttcaacagtgttgtacaactctccttgtagaaatctttgacctccctagttagctgtactcctaggtattttggtttgtgaatggctattgtgaatgggattgtgttcttgatttggcactcagctttgatgttgttggtgtacagaaatgctacttatttttgtacattgactttgtatcttgaaactttgctgaagttgttcattagatctaggagtttttaggcagatactgggtttttctgtatataaaattatatcatctgcaaacagaaatagtttgactttctctcttcgtatttggatgccttttgtttctttatcttgcctgatttctctggataggatttccagagaatatgttgaataggagtagtgacagtgggcatccttgttttgttccagttgtcaaagggtacgcttccagcttttgcctgttcagtatgatattggctgtgggtttgtcatagatatcccttattattctgaggtatgttccttcaatgcctagtctgttgacggtttttaacatgaaggaagttgaattttatcgaaagcttttctgcattaattgagataatcatgtggtttttgtttttaattctgtttatgtgataaaacacatttattgatttacatatattgaaccaaccttacatcccagggataaaacccacttgattgtgatggattagctttttgatgtgctgctgtatttgatttgctaatattttgttgaggatttttgcttctgtgttcatcctggatattggccttaagttttcttttttactgtatctctgccaggttttggtatcagaatgatgctgatctcataagataagttaaggaggagtccctcctcaattttttggaatggtttcagtaggaatggtaccagttcttctttctatgtctggtagaattcagctgtgaatccatctggtcctgggcttttcctggttggtaggctttttattactgattcaatttcagaactcattattggtctgttcggggtttcaatttcttcctggttgaattttgggtagttgcatgtttccagacatttgtccatttcttgtaggtattctagtttttgtggatagaggtgttcataatagcctctgagggttttttgtatttctgtggagtcagtagtattatccactttgtgatttctgattctgcttattcggatcttctctctttttctctttatttgtctagttagctattgatcttatttattttttcaaaaaactaacttctggttttgttgatctcttacatgcttttttatgtctcaattttattcagttcattttttcacatctcagtttcattaattaagttccaatattggttatttcttgtcttctgctacttttgcagttggtttgctattgtttttccagttcatctaggtgtgatgttacatttaagatatttctaactttttatgtgatgttacatttaagatatttctaactttttatgtgagcatttagtgctaaaaactttcctcttaacattgctttagctatatcccagagattctggtaggttgtatctttgttctcattattttcaaatagtttcctaatttctgacttaatttcattgtttacaagaagtcattcaggagtaggttgcttaattttcatgtaattgtatggttttgaatgatcttcttagtattgatttctatttttattgccctgtgatctgacagtttggttggtatgatttcagtttttttaaatctgctgagaattgttttatggccaattgcatggttgattttagactatatgccatgtgcaaatgtgaaacacgatgttctgttggttttgggtggaaagttctgtagatatctattaggtccatttggtcaagtgtcaagcttaggtaccgaatatctttgttagttttctgcctcaatgaagtctcccattattactatgtggttatctagatccctccatagatctctaagaactcattttgtgaatctgggtgctctactgttagatgcaaatatatttaggatagttaactcctgttgaattgaaccttttatcattatgtaatgcccttctttgtcatttttgatcattgttggtttaaaggctgttttgtctgaaagaaggataacaactcctgcttttcttgttttctgtttgcttcacagatctttctccatcccttactttgaggctatgggtgtcactgcatgtgagatgtgtccttgaagactgcatacagttgggtcttgcttctttatccaacttgccattctgtgccttttaattggggaatttagcccatttatattcaaggttaatactgatatgtacaaatttgatcctctcattgtgtttttggtgggatattatgcatacatgattgtgtagttgctatatagtatatttacatctgtttttgtggtggccagcaaaagactttcatttccatatttagcactcctttaaggacttctttttttattattatactttaagttctagggtacatgtacaccacatgcaggttagttacatatctatacctgtgccatgttggtttgctgcacccattaactcatcatttacattaggtatttctcttaatgctatcccttccccatccccccaccccatgacaggccctgatgtgtgatgttccccgccctgtgtccaagtgttctcattgttcaattcctacctatgagtgagaacatgcggtgtttggttttctgtccttgcgatggtttgctcagaatgatggtttccagcttcatccacgtcactacaaaggacatgaactcattattttttatggcatagtattccatggtgtatatgtgccacaatttcttaatccagtctatcattgttggacatttgggttggttccatgtctttgctattgtgaatagtgccacagtaaacatacatgtgcagtgtctttatagtagcatgatttataatcctttgggtatatacccagtaatgggatggctgggtcaaatgatatttctagttctagatccttgaggaatcaccacactgtcttccacaatggttgaactagtttacactcccaccaacagtgtaaaagtgttcttatttctccacatcctctccagcacctgttgtttcctgactttttaatgattgcccttctaagtggtgtgagatggtatctcattgtggttttgatttgcatttctctgatgactagtgatgatgagcattttttcatgtgtctgttggttgcataaacgtcttcttttgaaaagtgtctgttcatgtcctttgcccactttttgatggggctgtttgatttttttcttgtaaatttgtttaagttctttgtagattctggatattagccctttgtcagatgggtagattgcaaaaatttcctcccattctgtaggttgcctgttcactctgatggtagtttcttttgctgtgcagaagctctttagtttaattagatcccatttgtctattttggcttttgttgccattgctttttgtgttttagtcatgaagttaaggacttcttttaaggcaggtctggtggtaacaaattcccttagtatttgtttgtttgcaagggatcttatttctcttttgcttatgatgcttagtttggctggatatgagttattggttggattttcttttctttaagaatactgaaatgggcccccaatcttttctggcttggagggtttcttctgaaaggtctgctgttagcctgataggtttccctttgtgggtgacctgctccttctctctagctgcctttaatgttttttctttcatgtcaactttggagaatatgatgactatgtgtcttgggaaaggtcatcttgtatagtatctcacaggggttctctgaattccctgaattttaatgttggcctttctcacaagtttggggaaacttttgtggatgatatcctcaaatatgatttctaagttgctcattttctctctgtttcaggaatgccagcgagtcacagatgtggtctctttacataatcccatattctcagaggttttgttcattatttttattatttttcctgtaattttatctgactgagttaattaggaaaaccagtctttgagctttgagattctcttcacagattggtctattctgctgttaatactttcaactatattatgaaattcttgcagcgagtttttcagctctatcagatcagtttggttctttcttaaaacggctgttttatcttttggatcctgtattgttttgttgtattccttagagtttttggattcagtttctactttcttttgaatctcaatgatcttcattcctatccatattctgaattctacgcctgttatttcagctatttcagcctggttaagaaccatttccggaaaactacttcagtcgttttgaggtaagagggcactggttttttgagttatcagagtttgtgcactcgttctttctcatctgtgtgagctgatgatcatttagtctttgatgttgctgatggggtttttgcttttatcttctttgatactctttgaggtttgattgtggtataaggttggttcaattgactggcttcaattctgaaagatttcagggggccaaggctcagttcagcaatcttgggctacatgctctaactctgaggaactggtacagggcccttggctttgttatctggcctcttgaggtaaggaacctgctgcgcaggaagggccaatgtgttcttagtccactggccacactctgatgggggggtgccagccaaagtgcttcactggggcaatggcaacaggatccatactcattcacatgtgccaacagctgcattggtgcattggggtgcacatgcgtcagttggggtggggtgccagcaaaaacctctgccttcgttttcacagatagaacatactggcaaaatattttggtgttgtattttgggctgtggtccagtagatggcgcttaagagtgttagcagatagactcttggcggcatggctctttgtgctctgtggtagcaggggagagagatgacaccctcacctaatctgctcctgggtcttggaagagccccctccaatcactggctttatgcctgcatttcttttcttgggtgttctggtccagagaggtccctcaggcagggaccacgtttggcagacaggtaatatacttgcccagctggcccttcggagggaggtacaccccatgcctccactggcctgtggcatctcatctctctcagtgatccaagagtgagggctccttcctgcttgggcaccacccaagccagcaagtctcacttggcgatgagcagcaggagtgggtggagcccacctaatctgctatccaagtacttcctggggaacatgggattgtgcttgcctgccgagttcaggtagaagcagtctgctgggctgtaagctctagcaggcatggcccacctggctaccagtggcaggagtgagtggggttgcccgcccttctgtccaggtgattttcaggacaacagaagatcactccccttggactcaagagttgcccctgtaaaacttctgggtggctctgtgcctcagtttagaagtgtgggggatggagcgggcatggaggagagccaggggattttttcattcccagtcttgcacaggaccccacggggctctcactcacttgccttttcccattttggagaggttcttctggcctctgcactcagcccagacaggctggtgcccagcttcactcctctctgctctctatgtctccctgctgccttgatggatcccaatgtggttttttaggtgatcagcttgtagggtcagtgttcactagtcagtgaaaatgacacacgtgaactgcttctagtctgccatgctgacccaaactccccaacttccacatttttatagactgaaaggcttctcatcatttcatctttctgattatttacattttctagccagttgcataggtgaatataatattcctgctgaaaatagcttgagagttaagatcagtggccgggcacggtggctcacacctgtaatctcagcactttggaaggccgaggtgggtggatcacgagggtcaggagctcgagaccagcctggccaacatggtgaaaccctgtctctactaaatacaaaaattagttgggcgtggtggcggatgcctgtaatcccagctactcaggaagctgaagcaggagaatcgtttgaacctgagaggcaggggttgcagtgagccaagactgcaccattgcactccagcctggccaacagagccagactctgaaaaaaaaaaaaaaatcagtgtgggtccaaatctcaagtctgcccctttccatttaagtaaccctaggcaagtgtttaacccacttcaccatcagtttccatatctttaaaataagaatcacacttacttcatagcatgaaagtgagaatgacactctatgtcaaatgcctaatacaagttggccctcaatatttacactattttttttactgtgaacataacatgtactgggagaatatatttgagcagcattttggaaggaatactaaaatgagtaaaattaattcttataaatgcttcagaagtataaagtcagctacaagaaaactagaccatttttggccattcactcaaaaaatattaattggtgtctactatgtgccaggcattgttctaggagctggtggtgtagtggtagccaaaatgaacaagtctgctggttacatatatcttacctctaatgagaggaaaaagacaagaaacacataagaacctgagcaaataaaataatcttataggaataagagagctacgaagaaaatgaaacagggtcagtgggatgcagagtggtggaatatgccagggaggttgagcacaaggggaatgctgatttagagaagctgaaagggaaatcttctctggtataacatgtgagctgagacatgaaagaggagaatagcctacaataaacacaaatacataaggtaagagagttctatgcaaaagaaacaggccctattatgaaacaagcctggtgtaatcgagagagagaagaaaggtcagtgtgcgtggagcacagtgaatgtgagggagcccaggatgagaggaattcagaaaaacagacaggaaccagattatgtggggtctggtgggccatggagaggaatttggattctattctgatttcagggagcagccattggatatctttggcaagggaataataaggtctgatttaggttttcttaaaattatactggctgtcgtatggagaatggactgtagaaaaataatggaaggtgagagtccaggcaggtggctactgaattagacccaacaagtgatagcggtggtaataaagatggtgagaagttaacgggcttgagacatattgaaaatgtagctaaaggaacttgctcatagatggtatgtgggaagcactaggaaagaatagaatcaaggatacctcctaggattttggcctgacagcagtgtgttcctccagttggggagccctagagaagagactgtactgcagtagttgtgagacatgcactgtggacaaacactaagtttgcatcccctcttcatcacctgatcctctgtatcaattttctttttggtaaaattagaatcatatagcagcacttattactcagatgtgccttacggattaaattaataaacacgtgtaaagtacttaaaacagtacctggtgttagttattattaacgggatggggagggtgggagcaagaattctcttctacagttgctacatctatggtgccttttagatgtccaagtagagatgtgcaggcaatagggtattcgagtctagagttcagagagatgttgggaggaaagatataaatcaggaactcaatagcatactgatagtatttaaattcctgccactggataaaatcatctgggaaaagacagtagagaagagagtaaaagaggatcatccctggggtatgtcaccatgaaggtcatggccacatatacttagatttcacagaaatgatttgagagtctaaatgaattctttatttcactctttatttttagggaacatcctattcctaaattaattcacgaaagtctcatttgaagttctggatcacaaactgccctccattttacatttcacccatatgttctcccatcagattataggtccctcatggtgatgttatgtgccatatttttttaatgtccttcactcttcctagcacagagtaatacacataggctccctcaataaatgtctgctggaataattatttaaagaaattatgatgaataatctgtgttttccatggcaccatatgaaggactagctactgaggacatgaattattttgctctaaggaagaagataaactgaactcattttattagggagaaaatgtgaaccctgtggaaaaccaaagatgaatctaggcttataaataaacttatcttcctaaaacctgtctttttctactgcacaaggaaggggtgtaaagtgaaaagataatgaggctttagacttaggcaaacttgcgctcaaatctcccatctatataagttgtgaagccagaacaatttacttacgcatgtgaacccatctcatctttaaaataggaatgataataatacctacctcatggagtttgaaaaggtctaaatgagttttgtgatgtgaacagggtcaggtgatgcatgcacatgcaatgtgtggcattatagaagaagaaccctaaagttcgagaacccatatcttttatggcataaattggatactcatatattagtttccttatctctcctaaaaaatacactatatttttatgcaaggtttttgcacttatgaattcattatgctcaggacatagctcacaattatgtgcatataaaactcagtttattttttaaatgatgcatacaatgcaagtgattgtgtgtgtgtgtgcgagagagagatctgttgatacaaaagtacattgcagtataaaaaatgtacttagttttacatacataaatttacttctttcttaatgaaaatatgtgtgacaagatccttcatatgtaacaggagggatttcttacactgtagtaatttgctgcttttaaacagacttagcagcatccagaggcaaaggctgttatgggctcattatttcctgccccccagaggatgaactgtgctaattaagtacatttaaagggaaaaaatgcctctttgctgtgtccccattatgctactgtctctttacttcctgatgcttgttacaatttattagctgtgaattatacctgccagtaaattaacccttctttctccactcaatttgtcagataaaaaagttgcataaagttaaaagccagccagttggcttcctgagaatatagatatggaacaatttcctgcagcattgagcctcagaagaatttaacagctttggtgaatctagtaccaatgctcattttcaagccaggagcaaacacataaatcatgttcagcacaatgtacctgcctttagaaagctgtttacagccatgtatatttattagttttccatgatttcaagcagtatgttttctttaccctctccttttccttgcaagcacacacacaaattcctatcacaaagtctctctggtacgtcacaaaacacagcctttgggggtgattatttttcccgagtatttttacatcctcgtgccaatgcttcagatagtaccctaaattaactgtatcttttgctgtccatggatacttacaagtttccttttgccacttgtcaagagcagtgaagagtcttgagatttcacttgcaaactaacaagtcaccctgacatagtttcatggttgctggcagaaggtgcaacactcttagatcaaagagaaaaggactttattactcacagcattagcgttagccagagtagcagcatgtactccaagttctaattcctacagggtgatgtgaagagtgccagatgatacctgcacatacagtgggttgcattataggagatgaactctaagcttagggaaaccaaatattttataatggacagtaagcctgagtgacctttgccacagaagtaaatattgtctttttatgctgcaaaataaacaaaattgttctttactacaaagaaagacactatctctatcttccaaggttgtttttacagatgtcctcaaaacaacagtacagagcaaaggcactaagtgtctctgcccacaagatatgcataaatgtaagagtactgtattagtctgttctcgcattgctatgaagaactacctcagactgggtagtttataaagaaaagaggcttaattgactcaccgttccatgggctgtacaggaagcatggctggggaggcctcagggagcttctaattatggcagaaggcaaaggggaagtaggcacatcttacatggccagagaaggagtaagagagaggtaagggagaggtgctacagttttaaacaactagatctcatgagaactcacccacaatcaccagaacagcaagcaggaaatcaaccccacatgattcagtcacctcccaccaggaccttcctccaacactgggaattataatttgacatgagatttgggcggggacacaaatccaaaccatatcaagtaccatgaattattttaaaacaccactgatgctttttcttcatgaatgtgtattacaatttaatagtgttttcaatacatgagtttttacagttaatatggacttagtaacttgaatacataatcccaaaatcaagtcttcttgcaaagaataccataaaatcctttcttaaactaaatggaaattcaatttttagtaaatgtacttaatcgatgtgtaactcaatttcctcaccagtataatgaaataaatataatacttaattcgatttattattgagtagattaaatgagatagtccatgtagaatgcttaacacagagcctggtattcattaagtgttcatttctccataaatgttaattttaattagaattaattgtcagtaccctttgatgagaggtacttaaaatacccccttcactaaaccaccaccattgagcccacttccaaatgtaccttgggagtgctggtttgccttttgttggtatagaggcattcatcaggaaagggtagagatacaagaaagtaatattcttgaagacttattatgtgtttttagttgactatgtgacctagtgctttcatgtattatttcattccttcttaacagcattctcataaagaatgcattattttttagatgagtggaccgagattcagacattactgaaggtcacaccatttgtaatggaaaagcaggagtcaaaccctgtctcactctagtctgactctgtgcctttacaatttttaaccattcagtcttattttcctcaacaatctttctatcttttgggactaactatgcctttgtgacagaaaatcctctctactctgtagactccattgccaatgagaacaataggttcacagtggaaagagagattatgcctccacctgtattcttctaaaaatgatatccatctcttcatttttgaccttttttgaggaaatgacaagatgtaattcagaggatacaaagtagtagatatgtagcatgaacaagtctaaagatctgatgtaccacatgagaactacagctaataaaattgtactgtatttcggattcctgctaaatgagtaggttttagctactcttgctataaaaacaaaaaaaaaataggtaactatgtgagatgatggatatgttatttgcttcactatagtaatcattttactatctatatgtatcccataacatcattttgtttatcttaattatacatgataaaattgatttttaaaaaaatagtatccacgatgtgttaggcccaagcaacttatggcccaaatgcccctttttgtaccaaagcctatttctggatccataggctcagtcaacatgtttttctcactctttttgaaagtacctgattcctagtttagtgtttctgaaatctctctcaggaactttaatgacagtgtgacatctttgagaaatgcaagcatgacctctgttctgtcatatgttggttttacaagggacattacattaaacagaaaatatgaagtgataataagcctgcaataataacaaaatcctcattcaggaaagtgaaagaacttgtgttttacttttagagatagactcttactattacactaacacaaacaaataaaggttaaaaacatgcctttttaacttagttccataggaattttgtttcttaccaactctgcacgaaagccaattaaacattatttaaaaacaactggaatgggccaagcgcggtggctcacgcctgtaatcccagcactttgggaggccgaggtgggtggatcatgaggtcacgagatcgagaccatcctggctaacatggtgaaaccccgtctctactaaaaatacaaaaacaaaattagccgggcatggtggcaggcacctgtagtcccaggtactccggaggctgaggcagggaattgcttgaacccaggaggcagaggttgcagtgagctgagatcacgctattgcactccagcctgggcgacagagcgagactccgtaaaaacaacaacaacaacaacaactggaatgaaaaccaatatagggaaataatcttaacattagaatcaagtatgcggaattaagttttgtatctcctaaaatctttattgacagtagcagaccatatcaaaagtcttctgaaatgcttctagcgctctcaaaaatgctccacatcaagaaacttttaaaataaaataaaataaatgcctagtggaagagttcagacaacagtcccaaaactgcctgaagacattcagaattcctctataatctttatacagatattaagagaaaaaaagtactaatagaaattgttctggtttgtaattgcaagtataatcacacagttcctgaaaataatagattgatgttataatattgggcaagccaatcaatgaacacaatatgcagaatgataagtggtgaaaaaaatgctgcaaccttttgttgataacactgctgaatccaaactccaacccttgttcaagttgaacactctcgtttcattgttgggtaacaacaatgaatattgttgggtaacaattttatatatgcttctctttgggttaggtagtggcttgttgttgttatttgttttttgcttgctttgccctctttaaaatttttagaggaaaaaaacataacagatacataacatggtctcatgagaaaaccagaacacaaagccatgaaatgaagaatttcattctgtcaacctgtttagctttccctgggagttcaatcatcgtatgggcttttatgtgttccgctgagcatttactgagaacatcagccattatgggctgctgcctagctacatggtcatgtcgttacttcgcatttatctggaatcctctattctctcaacagacatttttattctgttccatatgactaccattgtgagaaagctttgttattttacttgaatgaggcagtgagtaggtctttattttttcaggaacatactcctcccctgtagctgtacctgaaaattaggtgactttctcatagctttttcaaacccataaatcttctgtccctttcacgcaatgtacttacttatatttcaattttagcatcttgcaatcaagtctgattcctagaccttgtttaaactttgggctgtttttaatttatgaatcgttttggaaatttttctttgcattgagttataaaatgtagactaaaactctagcaatgtagtaaaatcttttcaaagtttgtctttcatttattgatctgatccagatcctcttgtgtgcatcaccctagaaaccttcaatttaatccattttttttcagtacccctaacatcttaaaacttagtcattcagacaccacccacccgccctctgacaccttcttcctgattgaaagaggcatttatgtatatgagtcacctcctgccagcttcacaggaattacataaaagcaatctgccaaccatcttggcctaaggacaaaaaatcacatttagtgtcaaagtaaaagtcattcttgcttgttggaaaatcacaatagagcactttaggaccttaactcgcaggacatcaggccttaatctacagtctatactacaaatgagggaactcataaatgctatgctttcatcggtttgggtaagcttcttggcctaataatcctaaaaccattttaaatgctttttgtagttgaaaatgaaaggctaattcatattcaggaaagattatacatatattaaggggagaatgtggactaagaaataaacataatattagcaaaacacattatctttccatgctaatacaaaaatattcatgcagaaagttatttaaaaagcaccgcttatggcaggaaaggtggttttatggtctaagaaaaatgaattgaaagatttgcctagataaattgttataactagaaatattggtcaggatatttttagtttttttttgtttctagacaagacagcttagaccatatggaaatatgggtttaaatcttccatttaacctcttatttactgtgtgggtttaaggaaatctcttaacatgtctgagctttggtttccttaaatgtaaagtggtgaaatcgtgcatgccttctctctcttgagttgttttaaagatcacatagatgatatgtaaaaggacaatgtaacttttatgtttgtgtaattgcttataattctcaaaaagcttttacatatcatctcatttgagttggctactgtttttgcaagatcactacgaaggcagggaaagtcttaactctttctagctgataaaaagaatcctggaagatcccctgtattccatatcctttcccttcccatcagcacttccacctatacattcacagattcagggaacctgaaaggaagtcccattgtgtttctcagacacacatttctctcagctgtgaatatctctaatcagttccagattatcctaggaatttgagcctggcacaaatcatcactgtctactagaattgaaattttggctgccaacctagagcttctcccatgtccatacttgacatgtatgattgggcagggggagagaggatgagaatgtgtgtctctaaaatgcatcataagtcaaaccttgcatacaaggttttctctctctgttacaaaggacagcacacagaaaattaaagtacacacttaaggccagtacagacttatgacacttctcccaaggagagacagttccaagctcagaagtctagattttagtgcatgggaggttgaccttaccagttcttgaatgggataggtttctccatgtagaagctgtggaatgtagttagattcaattggagactatctctcataacaaggaaactcaccatatgagggatgttagaggagagttataacgttgtatcatttttttctttctttggtttcaatttccacctttattcagatgaagctgaaaataagtggaacagctggcaataaaaccttagccactaacttgaattttttgtgaaatgccagtcaagtaacaggaatgacagacatgtaagtaagccccagtagtatccatttttaaaaatatgtactgtgaataaaaataatagcaattagagaactttaaatcatattttaaaggataccgtcttaaaataatcactattcagaatttgatgaaagtaaaattttagggttatcttcagttactcatgttcaaataattttctgtgactaaaactttggtcaaaatagaaaatgtgttttttcctaggatgatctaaaggtatttattgtggatggaaagaattacagaatacaaataatatgaaactcaaaattacatcaaccaaatgcactttgttttctcagctgactcaaaataatgagtagccaaggtaatatcggctgcacattataccttctcacagtaccaggatacctgaagaaacaacacttcactcctagtctagtcagcacctttgcaatttttcttggaatgacgttagcttttacataacccatagtagcaagcttgtgaaacaaagaaaccgcaatttagttcggggtaactctaaaatgtttgtgttcaaattaccaataagactcgttttcatgaagggtctttctaaaatacactttctaagccagtgtgcgtattttcatccatattttcaaacagaaaaattaagaacaagacggatagtaactttcttgacagttatgccttggttgagaagtttaggtattaactcacagcttccatgtctagaccgttgctggctctctgatagttaattgcctctattatgatattatcattagagtccccttaagatagacaaaagaaaattgtaggtttctaggtctactcaattaaagcaattgagtttcatagtttcaggaaatgaccaatttaactcctatctggaatttgtgatattggaaacatttgtggaaaaggaacacattctaaagtattttgaaagtttcttaaccagtttttctctaaatcattgttctatagtaaacacagacatggataaaatgaattcctaaagatataaatttggaattttaaattaagatataatttatttggtaacaaaataagtggatttttaaatcctctcttccttagtaatagaacatctattatgttctccatggtatgcagacagtaatgtagaacttaaggggtttatatagttacctagacaattttatcatttactacatttttttgaagttatctttgtaaagaaaaaaaactttttccattaaggaatacatgttatcctggacttctggtgtcactaaaaggtcattgatttacatctgaactgggtcactgaaagcaaacgactatgtggtggcctaaataggtaaaatcgtggcatctttcccagtttaagagtcatctgaccaattataactcaaaatttaaatcaaacctacaagttattattagaagaaatactgagattggtctgaggctacaacataaacaaatgtgatctcagatattggttaattatttcaaagactaaaacattgaagtttatgttttatgcttcacctgtgtatatttgaatgccccacaccaattatacataagatctggagtgtattcccaacatcttcccaaatgaaagacctatgaaaaagtattttataaaaggtgacatatttagagtgagaagggctttatgtaaggaggaacacattattcatcctgagcagatgaaaagtaagacataaactttgagaacaaggtgaaagcagaggtgataactataaaagaatatcttgtcaaagaagaagcccatgtcaagcttactccatcatggagataaatgtcagccctgcttttgctcaaagagcacacctaagaggaaaaggcacaaagggttagagtgccaatagaaaaagaccacctgccacttaccacaaatgaataaaacaaatatatatccatagtccatggggcaaccatagcaaaggaccatctgatcctcacgacattgtcttaaagcattccttacatccccattaggaataagaagccgttaaaaccacctatacctacacctatataactagcacattcctgctgacagagcttggaaggcattgagcagttctgcatttgatcctacttttttcacaaagaggtgaatatcaaatattttaaacagcaagttaaagtttcagagcaaatataatttaaaatttggttctgctttgggaaatctgtttaggaggcatttgtaaacagttgaaaggctcattctaaactggaatggattgccccatcctatcaatgcccctgagatgaatatgaagtcagcaatgggagttttttaattctatgataattggctgggagttctttgacctttaattaaacaaaatacgaattaatgaactttctttctatttacagcagaggcttgaaatggtacaagttgggataacaatcaaaacaagatgctattttttcactaacaaataaatacaaaacatgatgctgaaatctgcatactgatattgatctaattatttattttgaacctgtaatttttcatctttcttcactcgaaggaagaaaaaacatcaggaaaaaaaggagctatttcttcttggatatatatgtcacacataagcaattttcaaatgtctcatgagctggtctcagtattaaaagaggcttctttagtctagcagaatttcagacaaaaattctagagcctttataacatagaagagttttatgaaagggtctgattggatgagatgtaaagagataaaatatgtacatagttacaattatattttacaaattaaacaaaaaactttttttcttgttttgcttttttcgttttatgccttaactggtgaacatttaaaaatatgctgttagatgagatcgtgccactgccctccagcctaggtgacagagagagactccatctcaaaaaaaaaacaaaaatgctgttagaatatggacacaaagaagagagcagtagatatagataccagatatagatacttgagggtgaagagtgggagtagcgtgaggatgaaaaactacctattgggtaccatgctcattacctggatgatgaaataatttgtaccccatagccccacagcacacaatttacccatgtacaaacctacacatgtatcccctggacctaaaataaaagttggaaaaaaaaatttagggatcattagcagatcattgcaaaatctgctaggattttgcagataaaccataagatccctcgaaaatatttttctttgtagaaaccatgtgagtctatacagcagggtctcaggagtatgagggataggcagtaatatgttcatcctcctgtttagtgagagaagcttccctgcaacagtttgagaaattgagcatggcagtttcgaaggtatcttccagctctaaatccttctttgtgataatcatgagtaatgtgatgcatccttactctgaccccaagcagaggattctctactcaggttctggtggccaaacctctcctgctttcactcactgagggaatggaagagtatttctatgaaggaactcctgggatctctaccctttcctgttacagtagcaatatgtttgtgccccactatcaccaccacatctactgaactagagcccatatagacctaatattagtgcccaaagtattgttgtgtattttttatatttgtattataattgacttcattttataatctctactatgttttttctttttcttaatcacttatatgcaatgtctatcatatttattgttatacatacttatgatgactttaaatcctttttatagaattgggatacagcattaaaattttattgtaatgattatgtttccagctatgaggcattaaatattatgtagtccaaaacttacaactctgtgaggtaggtattttcttatttatttatttatttatttatttattatattttaagttctagggtacatgtgtacaatgtgcaggtttgtcacatatgtatacatgtgccatgttggtgtgctgcacccattaactcgtcatttacattaggtatatctcctaatgctatccctaaggtaggtattttcattgtttttttttttagaacaaggaaactaagattcgggaaaggcacttgccaaggggaaaagttactcagtgtccttagagctaggattcaagcccaggaaacttccctctaaaaaccatactactaattacctttctcaagaaccttccaattagaatattgtcagaaagtcacaataagttattttggtacttgattaggcatgaaatctttgtgagatagcaggccgtttctgattctgattcctcaagtcagctggccttttctctttccttcttgagtcattatctttttgctttttctactgtcccttcactgaccctccaaacttccagtccaccttctctggaaatatctttccacaattttagttccttttttggccccagaaatgtacctcagcttcaggtctaaactactctaaacttcaggtcagaagcattaattaatttgtttattcattcaataaatatttatgagtgcctactacatagcactgggcaaactgtagtgaagggaacacacatgctccctgttctcatgtttcttatgttcaataggaatagataacactaaacaagtaagtatatagcataacgtatcagacactggcaggtgttgtggagaaaataatgcagggcaaaggaaatagagaagtctgagcctcagaaaatagagaagtgttgttacatttataaggatgtccaggaaaagcctgtctgataaggtaatatttgagcagagacataaaagaaatgtgaatttaaaagtgatgctctgaggaagagacttaggggcagagaaaataacagcatgagtaaaggcccagaaacaggaataatcttgtgtttccctaacaatgagaagggctgtgcgctggaactgagtgagaatgaatggattcctaaaattgcttgactcatctataattcattcaagaatggcatttgacttctaagatagccatttttcagaaaatttattttagattatattaattttttatacatatgtttatcgcttcacagaataaaaaaggcttttcccagatattatctccttttctcctcaaaacatgctgtcactggatcatgggtctaatttgatttgattatcccagcaactgacacaagacatgatgcatagtaagcactcaataaatgtatatggaattaattagttgatgtattaattctgtggcacaatttctaatttttcacctttaccatgttcattattattgaacatcagtgatgggactataattcagtgaagcttcagaagctataaagatttatctagccatttgcctgtaccctaacttatatatgtatctaatttttgtgctgatttacactttttctgcctaactcttccattaagttctttaacatctttcttcgcaatcagtttatgtatattcctaacttatcgtatctaatctgctatattcttggaaaccagatcacaggcctgttagacctatatgtatgtaaaataaagtgacttttaagtgagagcatgaaaccctttcttaaagaataaatttgccttagttcatttgtactgctacaacaaaatgccacagactgggtaatttataaataatagaaatttagttctgggagctggaaattccaaggtcaaggcaccagcaggttcagtgtctagtaagggttaagtgtctctgcttccaaaatggaaccttgttgctgcatcctccagaggggacaaacactgtattttcacatggcagaagggatgggaagaagcaagcccacttcctcaagcctttttataaggtcattgatcccaatcatgagagctccactgtcatgatttaatcacctcctgaaggcctcacttcttaatactaccacactggcaattaagtttcaacatatgtattgtggggaacacattcagaccatagcaaaattcactaactttactacttgcttcctaacagctgttctgatctcataggcattttgcttatttttgcatctgcaatgtaattctagtggattaaagttgttaggcacagtatacaattgtgcctttcccccaacttgcatccaaagaaaattataacgcatttcatcccatcaaacttataatctatggtataatctaaagccacattaagaggttattcatcacaccaaactgatctcatttaccagaagtagccacagcttacaggtttgtctgagcccttctttttcctcactgaagcaagggttcccaaccaatattgattatctacccacttggtgcaacatgattgtaaatgtgccccttgttttggggtacacttaatgtgtcctttccatagaagtcattatctctatttaccctttagttaccctatacaaattttcagtcaaatattattctttcctcttctgactaagaattttttggcattaccagtaattaatttattctttcattctttcagcaagactctattgggagcctactacatgccaagcactgctctgggcactgcagatttagcattgtagaggcagaggttacctttattctgttagctaaatgaatagctctaagggtaagagctaaatagatggctataaataaaggtacaccaatagtaatagcgataaattctatgaaaaaataaagcagagaatccaggtatagcgtgataggctgagcatttatttaaaagagggtggtcacaaaaaatatataagcatgtgaagtgatggacatgttaattagcttaatttcaccatttcacaagtacatttattaaaacatcaccttgtacactataaatacatgcaatttttatttgtcaattataccttaacagagctgggtgaaattttaaaaaaaagaaaaaagagtggtcaaggaaagcctcaccaaagaggttatgtgtaagtggagacctgaaagagtaaggaagtaaaccacatgagtatttggggagagcatatccttaagaggaaacagaaagactaaaaccttgaggtgtgaacaaacttgatatgttctaggagtagcataaaggcaagtatgtctagagcatagtgagtaggaaaggaaatgatacaatataaggcctaaggcaaggaccaagtaatgtaaggatttttgaacatcagttgtcactacttcccaacagttcattgtgtgtttgacttggtgctacttctggacagttttcttaaagtcagtgtaaagagcataggacatgtattgcaaataattttggtagggtaacttgcatgataccatattaataaaattcaggagaaaatatggagacaacagtactcacagttgtacattctgtttttttttttgtggttgttgatgcaggtgaaattcacttatgtaaaattaactattttaaagtaaacaattcagtagcattcagcatattcacagtattgtgccactacaacctctgtctaatccaaaacattttcatcaccccaaaaggaacccatcctcattaatcagttgcacccaattttccctacactggcaaccaccaatctactctctctatctatggctgtacatactctagatatttcttgtaaatagaagcatacaatatgtggccatatatgtctggcttctttcacttagcataatgtttttgaagttcatctatgttataacatgtatcagtacataatttgttttcatagttgaataatatttcattgtatgtacataggcaaatttgtttctccattcatccacagatggacatttcaattgtttctactttttagctatcgtgaatagtacaaccatgaacatgtatgtagaagtatttgtctgaacactgtgttttgttcttgtggtacatacctagaagaagaattgctagatcatatggtaattctatgtttaactttttgagtagtcaccaaaatgttttccaaaggggctgaaccacattacagtcccacagcactctgattcttaaactacctctatatacagatgctccttgaaatacactgggattatattctcatgtattgaatgcatgtcacttttacaccatcataaagctgaaaaatctttacttgaaccatcattaaatcagggcttgtctgttctctgcaagctcttgcttcctcataccttatcttccctagattggagctgtttatactgagttatcatactttgccaaaactgataacctgattagttggttctcccaaaccagctgaaatggactttaattagaaaaactaagaaaaataaaattaataaaaatataaagctaaactttagaagctaaaattctgttgcataatttctaacccaaactaccctagtcatgatatatataaaagatagacggatagacagataatcttctattgattctgtttcactagagaaccccaatacatactccattatggctagagtagatagatagatagatagatagatagatagatagatagatagatagatagacagttaggcagatgtattataaggaattggcttatgaggttatggaggctgagaagtctcaagatatgcaggcagcaagctggagatccagcagagctaagtgtgtagttcctgtccaggtttgaaaatctgagaaccaggagaactggtagtgtgcattccagtctaaaatctgacaggttcgatactcaagagtcaatgtttcagtttaaatctaaagataggaaaagatcaatgttccagctcaaggcagtcaggcagaaggagctccctcttacttgcaaaatagtcagtctttttgttctacttaagacttcatgtgattggatgagggccaccatctttagagaaggcaatctgctttactcagtctactaattgaatgttagtctcatccaaaacatcctcacagacacacccataataatgtttgaccaattatctgggcaccccatagctcattcaagttctcatgtaatgttaaccctcacagagtacttttgagccagcacaatttttaggacctcaactgaattcagatggcccttatataacccatgttgtctagagtatttcttattggagaatccacagtatctgttaattatgaggcttatgaaatcattgattagctgaattatttccttactgtgtaccagtaactgtaccaagaagtgaacactaaagatttcatactcaaaaggaaaaacaactcataaataaataaattagaaactaccttgaactatttgaaatcaaggaatagaacagtgattcttaacagtgtggtataatgtcccctatatcaaaatcacccagggtatgttgcctttgctcagaatgattgttctgaatctctgggttaggacccggaagtctacattttgttaagtttcccagataatctttatgtacatagaagtttgagaagcactgataggaaatgcttttattttagcaattttcaaaataatttgaaatcaaatgttttctaattactttttccaatttgaattatgttgaaattcttcaccaagattcaaaacagtttatgaaaataaagtagtaaataagtgttctacaatggccattttcaaatctttatgagtttattgccttactagatcaatcaaaattcattcatgttcccattcaataaatacttactttcccttctgttcttgacatcacgctgggttttgggaatgcagcagtgaataggatagacattgctcatggagtttatagtccagctttaatctcacattttgtttttaacacataacacaaacctttttttggaagggggtgggttgctgaacatttaattactgtggttttttttaagtatttagcattttcatgtcttgagcagaacagatgcgctacttaaggagtttcatacctctgcaactaaaaggaaatctatttgttctgcaataacagtaagtggattgagacacctcagtcccctcatgtgaaatcttacagctctgcttccttttctgctttcctgttaaaagcaagtattttaaattaaggtattaaaattatgtttatagtaatatataaacatcccttttctgcacaattgaatgaatgagatttaactaatagtttcctagagatactatatagcaaaaaataatgaactatttttaacacttattttcttttaaaaagtacattagtattttgactaagcatgtcaaccataagctaaatagcatatgcataacaatttcaagtgaatacttcgtgatggtagcacttacttaatagttttctcttttccccactaacctgtcattatttgccaatttcagctcaagaactcctctgggaaaatcattcttcaccgctgtaatttagaggttatatataatgtatgctcaagaccagttaaagtatgtaacagaagtaactcaagattgctctataactcttttctctgctttcacacaaacctttgtccttactctgttattacaatagaaacaataaaatacataagcattcaggtgaagaatgaaaattcactaatgtcatttagaaaaaataccaagaagggtttatatgaaggatataaagccctgtgaagttactataatacagctacttggattatcttcctgtttagtgctgattaactccaaaagtgttacggctcaatttaaaaatatagtttaaaattttaggcatatgcctgatgttttcatgtgagtaacagaaagtaatggaacatggaattttctgacaggacaataaggaccttttaaagttggcagaattacaaaggatttcattcacaaagctaaaactcaacttctgtgtattaggaaaggatttaagaccatatatccatttctcatttgatcttcatacaaaacctgggagttacatattgttattcttgttttccaagggggaactgtgatttggaaaggttcagtaacttgtccaagcctcgtattattactgcatagtaatcaagtagcagagccagagtcctaagtcactcggatttcaatctgctgctgttctgccatggtcatgtatgttggtgaggccaagcacaagaactgggcattcagcagatggtggccttggcctaaggcaatttaacaagagcgaagataatctctaagactcctcactgtacttagcaaattcctaggtgaaagctcatagaaaacacagtccagcctttggtctttaagactattttaatctggcaggacaaatacagtttctacatttttatatgtagacttcacatttagaatatgggcaactgagagctgagtgattgttttgccattaggagtgttaattaagttagataatgcagtgctatgtctatagatttcttgtcaagggagtttaaatactgttgcaaaaactgactgggtattatgcttcccactagcttacctatctttcctgcattctttcttatttccctgctgaatgtcaattgtgtaggtaggtcaaatagtaaagttgatcctggccttattatttattttcctctaagggtatctttcctctaattgttcctgaggccctactctaatattaacctaattaactgttttcagcatatttcaatgtttttcttgtctaagcacaagtcttgtatagtctttccagttctaaacctggtcagagagagactaaggtggtcattggagcacttcatggtgctccagtgtcctgcagtccaactctgcagattgtacagtgagtaagtgttctttaatctggatgccagtgggtaaacattactagtttggctggtgtggtggctcatcttatgtgtgaacgtaactaagctaagggatgcccatatagctgctacaacatgatttgaggtgtgtccgtgggagtgtttctggaagagataagcttttgaattggtgagctaagtaaagcagatggccctccccaatgtagggggcatcatccaatttactgagggattgaatagaactaagaggtggaggaagggcaaattcactctctctgcttgagctgaggcatccatctttatctgcctcagacataggcgctcctggcttcaggctttcaaactgccacttataccatcacccaccaccaccaccaatttctcaggccttcagatgcaaactgaattatatcaccagctttcttagttctccagcttgcctccacaaccacatgagccaaatcctgtaataaatggcctcctatatctatatccatatctatttcctatcgtcctgtctctggaaaatcctaaataatatagctgactattcactgaccaatctagtcttcccattcccctcatacctttaggctttgaaaactaaaagtgacagttaaatattgaaagtggaaaaaagagcatccttgtcttcgtttctggaagattatgtcaccacagttctgtatgccagtgataagagggttcatgttgtattcttgttgtttccatggacaacagaagcagtgagctttgaaatccaaaatccttgttaagtcacctctttagctcttaaatagctttgtgaccaagggaaagccacttaaactatgtaaatcatgtctaccacttctgaaatgggaataataatctctagtatactaagtatatctgatgcctggaggaggtatgagtgcgtgtacacgcgtgtgtgtagatagacacataggcataggagcttatcatttgctgcttaattgatttcatttactctagcaaatatagacatttatatttctaaatagtatatgattgactataaaatattaactctaaaagtactgtgctcaaacaaaaatatttttatctgctaaaataggccaaaatataatctaagaagcataaataagaaacaaaaaaattatcaagacattccaccaagaatgccacacgtgtcatcaacactaacataaatcttcatgtaaaacttctttgcaattacttttaatttcaatttctgcctcttcatctatttgatttattctgctaacaaaagttagagaaaattcaaaggctatcattttgctcagttctcagaactcagattctttaaattagttcttttttgtcttcaactagatattttaatgcctgcaaactttcttagctttacagaatgaagacttgaaaaaaaaaaaaaactaagttagtggggtagcatacagattaaaatttggaaagataattttgaaatttttgtgttaaattgtatttgaaatgcaattatcatataattaagttgcacactatgttcccttctaacactctgattagcattttcaactgttttgtttgctaaagcataaacaattattttctgctgcagaaatggttgcttcattgctgtagccatgagtggcttaatgatggaggtgtgttctaaaaaatgtgttgttagccaattttgttgttgtgtaaacatcacagagtatacttacacaaacctagatggtataccctactacacacctaggaccaccaaaatatacatgctacattgttgactgaaacatcattatgagattcataactacataagtatgtgttgatacacagagcagtatttatattagtcaaaaaagtaaacaacttaaatgtacaacaataggataaaatgggtaaataaattatagtatactcatttgatgcaatattctgcattcattacaaaatttggttttggaagattaatgtgataggagaaagcccatgatatactgtcaaatgaaaattcaaaactctgtatttttaatcctgattggtatagctttaatttttattttatggcactaatttacctatataactatatgcctgcaaatattattatatatgtttatttattgagaaaaaatggaaagaaaacacatcataatactttattagtgattttaattatttttaattagaaaaaatgttattttaaaaataataattgatacatggaattgtaaattaccttcctatatatagtacagtattttggaaaaactaaaaacaaaagtcccatttttcaataatcaagccacttttgaaggtagacatctatgttcttagggttcctggattggcatttgaggagaccactaaattgtgcctcttcagacaatcgtgattccttacctcctccatgaccacagtactctatcagatgggttttgcttgcccagaatacatgtggttttctgtctgtggtcgtggagcactgacttaatttattataattagaattttagatatgatcacaccattttagacatgttgcatatacagaataaagtataattttatatcatttttatattttgttcatagtaatgagtagactacttcagtttaaaatagaataatgctgaataaaatcattctagtaatgaagggtttagtgaaaaggatatgacctaagaatattgctgggtacttaagctttttacaagggttaggccagtaacaaatatatttttaaaaggtgggaataatggatgaatgtataataatgttctcataaacatctgcaaaatctggtttacaaaaacaacataaaagatgacaaatatcactgtttatcttaagtatataaaatatcatctagaaataattttcccctctttaccatatataggcataattagtatctgccatctgtttcaatgtatcttttatgtgtttagtgtttatttctagaatatcaaataaataggtaaaatggaaattcaaatctgcaaattcagggctaatttagtaacttaaatcattgtattctagttgactaagaggttagttcgcaggaactttatttagcttctaaggcctaagaagaagacaggtttcttatatatagtttttcttatcaagttttgtaaatgtacattaaaaatgcaatcaaggatcacaaagcaaagttcgaattccaattaagtttgaacaaaaagaaaggcaaaaagaaggttcattttaccaaattgtaagacttaaagcactgaacacaaaaaaaatatgttcaaatagatttcgaatctatattttaaccactgaaagaagaaaaataagagactgaaatgaagtgagtaaaatggaaaaagaagaaagatatgatctaagtggaaggaaagataggaagggtgggctagaatgttcaactggggaacaacagaattgagagaggaagaaggggagaagaaagaaagggaagatattataattgtcagcattatatatatatatttatacacaaaatgtgtgtgtattataattgtcagcagtacaaatatacagacacttgtatatgtatactatatatcttacacctaggtatatccttccccacaccagggtccagcatctgacctagaagtcccatttgtaacttcatcatgtccagctggctggattcctcctcccccatccaaaccgtgccccaccttgtaaggacctaacctgtccctgatgacattgctgtcagttcattcttttgctcccatagttaggtgtagagatccaccaacaggcctgtcttctatttctgagtgtcatcaggacgcacatattacatggttcagctgtgcacaccaaaaagcttgcttatgttaagagagtagtgataccaaaagaattagatagctaaatttcaaaaacttaccattggctagatgagtctaaatttgaacccagaagttctctacctctgcttttaaaatcaggaagaatctcttgcattcagataaagcatacaatcatggggtagtcaatgaataaaaaactctatctgcttatgatccaaaaaagttgggaccataaacatgatgaggcagaccttccagatgtcagctttataattaagaaaataagatttagttgtgggcccaactgtattaaggaaagggagaaagaagataaggtgtgatagagtagaaggaatgcctaatttggatctatatccgtaagctaggataccactaatttcatctatgaaagatcatttacaaatctaacagcattactttctgcctagttgaagtgaacactcaactaccgtgtgtgtgtatgtgtatgtgagagagagacagagacagagaaggagacagagagagggagtataagaatcagacttaaagattgagaaagaaaaaagaagaaagaaaagtacattaaatactcagcatggtaaatattttataggatataacaattaaaactctgattcaaaatagctttacttatcagaagtaggatattttattagtctgttttttaatgaaagggcaaattagagatctactttactatgatatctcattttgaacaacaatcattatcttttgggaatctcagattttgattttgaaaaccaaagacttgtctgagaaataatctgtttctttcaacatacgttcttgcatagcttcactaaaaatgagtgcccttcttttggcaattggtgatctatatgcctgaagggtaaattggatatattttatgtactagatcgtagttcttttgatacctacagaataaactcttttcatttaacttcctttttccaactgacactttttgctgatttattgcaagctaaaggataaataaatgtatgtgtttcatgtaaactcaaaagtatctctctagttttaaagtgataaagaaactattttccaccatttaattctcacatgtataaggaactggttttatcctctgaatgcaaaaaggatatatcttttggaaactttttaatgccattctttacctgatacattttttaaattatgtatttcaggccctgcttgatactcagaatcttttgcgtgcacaaatcacaaattttacattcaacctgggattttcagggaaattttaccatacaggtaagaaaaagggattaactgttctcattaaggcttctctgatcactctatttaaaattgcacacttttcctgcccacactgtcctacattccctatgttcctccccagcattttatcattcaattctatttaacatgctattttttaatttttgtaaaatattaatggtttgaaagtttatggaactatctgatggcctttcatttttattgaattataatttacatatatagaagtacataaatagtaaatgtgatattcagtgaattttcaacgtgtacacagctgtgtaaagaacaggcagatcaagaaagagaacacttccaaaatctccacttcttgtgcccctcacaataactaacttctctcaaagaagagtagtattctgacttctaatatcatgaattagttttgcttggctttgagtggtatgtaaaaggaatcatacagtaaagattcatctgtatccagctcattttgtacaatgttatttttgtttcagaaatattactgtctataggttataattctttccttttccttgctgtacagtattccattgtctgaacatacaaaatttacttgtctattccattaagctgtagatggttgggtgtttccagactttgagtttttctgaatagaaatgttcataacttcctgttacgaacatttttatacctgtccttcagaggacttgagtattcttttctgttaatcatcaactaggaatggaattgctagttatgtggcacacttataattaattttagtagaaaatgtcagtttttcaaaatggttgtacctgtttatattcccaacagtatgagtgttcctgttgctctgtatgcttgccagtatttgatattgtttgtctttttaattttagcttttctggtgaacatgtagagatatcatattagggttttaatgtacatttctctgaagagcagtaaatgatctttgttcgtatgttggctggctatttggatatcctctcttgaggagtatctgggttttctgcttttacttaatgatttgtagaaattctttccttgaagtttacagttccatgtgttccaagtactttctcctgctgtctggctgtctcttaattttccttatggcgtttttaatgaacaaaaatacttaattttaggccgttcaatttatcatttttttctttaatggtcattcttttctatcttatttaagaaatctttgcatactacaagaacatgaattttttttctttttgagacaggatcttgctctgttgcccaggatagagtgcagtggtgcaaacacaactcactgcagcctcaacctcctaggcttaagaaatcctcccacctcagccttttgagtagctgggactacaggcccatgccaccatgactggcaaatttttcttgtagagaaggggtctcactatgttgcctaggctggcaatgtataaatctgtgatacatctggaattgatttttgtgcatatatcagataggggtctttttttcataaaaatatctaattggttagccagacatggtgacatgtgcctgtagtcccagctactcaggagacttagatgggaggataacttgagctcaggaggtctaggctgcagtaaactatgttcatgccactgcgctccagtctaagcaacagagcaagaatctgtctcttaaaaaaaaatctaattggctgggtgtggtggctcatgcctgtaatcccagcactttgggaggccgaggcgggtggatcgcgaggtcaggagatcgagatcatcctggctaacacagtgaaaacctgtctctactaaaaatacaaaacattagccaggcatcgtggcaggcccctgtagtcccagctactagggaggctgaggcaggagaatggcgtgaacccagcaggcggagcttgcagtgagccgagattgcgccactgcactccagcctgggctacagagcgagactccatctcaaaataataataataataataatcatcatcatcatcatctaattagcacccagtattgaaaagaccatcctttcccactgcttcatagtgtcattattatcataaattatatggccatgtaactgtggactctcattctgaatttccctattaaatgtgaaaagaaatcactctaaatattgagaataattaaaaagttttttcacaatcataattaaaatgagtaaagatattttgacttgcctcaggatagatgaacacaatttcatgattgaaagcattactctgtatttttagaagttaaaaaaactgattacatgtattggtatactcatataatggaatactctgcagtcattaaaaagagataattttaaatataaaccatatagaaaaagctctcaagatacactgaaaaatcagtgtacagtacagtgattagaacatgctcccatttgtataaaaataaagaagataaaagctatacaaaagtcaaggtatagtacagtgattagaatatgttcccatttgtataaaaataaaagaggaggtgaaatctgtacaactctatgtatagaactcttgtagcttagaaaactcagttaccaagtagttaagtaacttgtgccatgcaagatgtcttaaataagatagaaaaggctgaccattaaagaaaaaaatgataaactgaatgacgctaaaattaagtattttttatataaagggctattaatacaagtataggatatctgtgggagaattcataataaactgatagtaatgggtaactatgaatgtattagttttcatgctgctaataaacatatacctgagactgggtaatttataaagaaaagaggtttaaaggactcacagttccacatggctggggaggcctcacaatcatggcggaagatgaaggaagagcaaaggggtgtcttacatggcagcaggcaagagggcttcgtaacttaatgcagggtaacttccatttataaaaccataaaatctcgtgagacttctcattcactatcatgagaacagtatgggggaacctcccccatgattcaattatctccaaccagccccagccttgacacatggggattattacaactcagggtgagatttgggtggggacacagagccaaaccatctcagtgaagaagagaatttgagaatcaaacaagagagatgaaaagaagagttactttttactaaattttttctgagcctttgcattttataacatatatgtgtgttagatctaaatgaataaacacataagtaattttttaaagtgatatcatatttaagcaagtttatcagttttctacaattgcaaatgcttttcaaatttttcatttgataatatgagcaagagttactttgtatgtatttgatgagtaccttcaagggtttaataaacatatcatgctgagaattctatctatatactactaacatcaatataatctccatatgcacataaacaacataaatagtaattttatttttagatagaagcatactgtatttctagagtaagtcaatttccatttgtttccatggaagttagagagccatgagacttgactatagtattttcctattgtaaaattgtgtaatgaatacaatatgtataatcatacaactacatataactttcacctaccaatttgaaaattgtgtaggatttaagaataactttaacataagaagcgtggaagcttttattcctctgaatttcttagatcaatatataaaatacacattttctgtgattattttaaatattaacaactgggaacctcatgattatgtttgactttgttttatgattcattgagttggttcttattgtaacctcaaaaataaaaacataattagatatctattttaaatcttttgcttacaggaaagttcttctaccttggcaatagatatgtgaagtgagaactttctctttatgtgcagaggtttagttcatctttctagtgaagttagactcatagcataactaactttcacaatggagagctccaagagcttaaggaaacagaagactgcccacaacctcttcctaaacttctgagttaggatatcctaacttcaggatgattatcttagattctttgacatccattgaataaaggaaaattatcatatggatgaaaaaccaccatggcaaaattagggtgaaatatgtggtgtgtttagggggagagggagagagtaggaagagacatcacagcaaaaccaggacagcccagatatgctcaagaaatacaagaaaacactcctggcaactccattatttttttgcccatcgttgaatactggggaatgatgctagccaattcatgtcattccttctcatctctgcaaggtttgtcctctttctttacttgggcacttcccacagctcataataagagtatcctctccctaagtgagagaaagtacaacacagatggaaacagaggccaaggtttgaaagggtcttgttagctgtgtataatatgagagtttccacaaaacttagccagggttgtctaagaccagttaaatcattttttagagggaaaagatacaaaatttaatatttgatctttcaaaaattagatgggataaaaagtaattgaattatattgtcttcctttctaaatgaagaaattgctattcctttttctataaaaaaattctatccattttactcagtcttgaagggaaaaagaaaagtggcattgtcataacagtaatactttatgtcagaagagagctttatcttgtttgatttattttaatttttgaagggtatgtgcatttatgtgagaaataaaggggtaaaacataaaaatcatagttcccttttagtgctttgttaaacacttttcatgtactttttcactgaatcctagaagttaaagaacgtgttaacttgttttctagataagaacatagaaacttaaaggggcccaaggtcacatagcttgtgaagtgtcaaaaaatagtcttaactcatccttgactagggaagctgaatggcaaaagattctccttatttatagatttgttagctttttatgtttccccaaatcactgagatccagtagtacctgtacattctaattatattatagaataaattaacaatgagaagagcaatgttatattgaatgaataaatgctgatcttatttctagactcaacgtttggccagtgaatgatagttaagggccctgaatttggagttgctcaatctgagttagaactcagaatttcaattcaggctctgtctcaaacctctcagtgagatggaacaagttacttcacctctccaaatgtcaattcccttatctgtaaaatgaagttagcagcagcactcacctcatgaggttgttttgagaattaagtgaaatgatgtttgtaaagtactcaacacagtgcttgacataacaacacaacataaactctcaatcaatgatgattttaaatataatatcagaatagcaaatactacagataaaatagtgtagagaagttatttaaataaatatattaaaaaataaattatagtttgcaataacttcataagatttcagcatagttttgtgataagttaagaaatggcacttaacactgtagaaaagagtttggaaatttctcaaagaacttaaaacagaactaatattcaacccagcaatgccattattggatattatcatatatccaaagaaagaaaatcattataccaaaaagacacatgtactcacatgttcactacagcactattcacactagcaaagacatggaatgaacctaggtgtccatcaatggtggattggatgaaaaaaatctgatacatatactccatggaatactacacagccattaaaaaaggaatgaaatcatgtcctttgcagcaacatggatgcagctggaggccattatcctaagtaaatcaatgcaagagcagaaaaccaaataccacacgttctcatttataagtgagaactaaacatcgagtactcatagtcatagagatggcaacagtagacactggggactaatggcagagagggcaggagaagagtaaaggttgaaaaactacctgttgtgtactatgctcactatctgagtgataggatctttcatatcccaaacctcagcatcatgcaatatgcccaggtaacaaacctgcatgtccccccgaatctaaaataaaagttgaaaataaaataaaatacatacaatctgcatcttcccagaaaaaggaaatggcacttaaaattgaggaatttgacttcttgttcttctctcttcctccagttctgacaaaggtgggcaaagtagggaagcaaagagtgggcaagaggccacgacagtccaaccaaatgtaattaacccatagttaattacacttcaactaatttttaatcatgatttttttttttttttttttgagatggagtctcgctctgtcacccaggctggagtgtagcgacgccatcttagctcactgcaagctctgcctcccgggttaacgccattctcctgcctcagcctcctgagtagctgggactacaggtgcccgccaccatgcctggcaaaattttttttgtatttttagtagagatgggatttcaccatcccatctgaactgagataaatatgtcagaaggcagatatcatttgtctaactcttgcatgattcaaatatatgaatattttagtcacagatttcactatgatattcaggaaaggacaacaaatgcctgagctatctttttagccaggatggtcttgatctcctgacctcttgatctgcccgcctcagcctcccaaagtgctgggattacaggcatgagccaccatgcccggcccataatttttaaagtaataagcaacagacatttgttttcaatgtaattctaatgtaaaacattctcaaagtaggattaaaagaaatcagataagacaaatctataaagagaagacataaaattgtgcctaatatgaactgagataaatatgtcagaaggcagatatcatttgtctaactcttgcatgattcaaatatatgaatattttagtcacagatttcaccatgatattcaggaaaggacaacaaatgcctgagctatcttttcaaagaaccctgagatctgctgctctgttctgataaataatatttgagcagaggccaactaaaaaaacatgaataaagggaagatgacaggaaagcttcaaggaaagataagaattataggcaacagggaatagagcttaaaagcagtgggagaggagacttctcataaactagggaatatcagctcactgacattgcagggtatgtggaaatcaggaatgaattgatttctgggaaactccaagagactctgcctgctctcaatgtgagaaaataaaatggcaacaaataactgacactaatacagtgtcctggagactacaaaatgttaagcaacaggggagtatcttggttagaagcagagatgtttaaatgcagggaaactaaatgacatcattcttatgtcaagcaaaacatgtgtttaagatcaccagtcacacctacaaaatgcttctttacaaaggtcaccttatttatcacctcgaatttagaaggacccaagaacctgctatggttgggatcatcagagtttctaaacccctgaatccatcttcctatttttcttgcctttctcactatgaagcttccctgagccataagataaccactcagaagcgccaagaatgctggtgactcattcattaatcaggccaatgagttaatataatgatttggtcagttcttgaacataatgtcacctctgccacatagcacctgtgaaaactaccttctcctttcatgtagtattataatgaggaaaaaaaaactcaaggagccatgcaaggaaacacaagaagaacagaagtaggaaatacaggaggaaaagaaaggggtattataagttacccaatattgccagaattatgtatacactacctccccccaaaaataaaataggtactgctgtccatctctttacctacatgaatacagacattaaagaggtcatgtgacttggccacacaactcaaatatgttggaacctaaaaataaactaaaaccttctgactccaaaggctacacttgttctactatacaatggtaacataagtgtatatgaagaagaaaaaaataaagaaaataaaacattagatttaaatatgtaatctttgtacgtagtggagaggaagttccttcatatcagtagagtacttaagcatgcgaaagtgaaactgaagactgcccttgttgaatgattatgctattccactcactctacagcacttaatctttgtttcttctgtatacatttgaatgaccatgaaatctcatagtatgcctttatctctagtaaaggttttcaatgcccaccaaatcacaggacctgattcttttcctgccaataggctctgcctcccttctttgggaaactgaatgaacaatgttaacaggaactgggtttagttgactggtccagggtagcagtccattctccatctttagcctgtagggctctaataaaacaaatcacatcagagctgccattgaaaatatgggaggagatttttctccacacaaaaaggacatcataggaagaacccactactcagggagcttattggattcaatgttgtggctaaaattcaagtgtggctgcataattttgaaatgactagtattatgatattccaggacagtagtgagcaccttatactgctcttattttatgctatagtaaagaagatatgcctagggaagtacaaaaaggactcttagccccttcaaataaggtaaaagaacagtgaaatttcccacagtcaactgaactgcaggccaaggaaaatgggaggaaataaaatgagttcaagtatgaaaccaccaagaaacaacaacagggctgacccttaaggaaaaaagagtttcgtgatgcaaaatcttcttccaacaacttgagagaaaggacaagcatatggaacacaagtgtaccaccaaggagcagcttggattgttttgatagtggtgaccatgatttcaccacttcacaacttctgtccatcaccttcatccttcagttttccctaattttctcaacaacgatttccacatttccttcttttctctttcttatgtgtcagttttcaccaaatactgagtaacttcttcccagacctaaggaggaacccgaataaaagaattattttgttgtatacacagcccatgtcacaatgacctactactactgaggctgtgacacatattccttgctcatatttcctaaattacatttcctacttatcccccattctctccagactataaactgcacaaaaatgctgaaagttaagagttctaatatccttgggaatggttatatatttccatcttgcagtgatttcatatccatgtctcatgtttaataacatttaagagttttacatggtctctgattatttcctgattaacagattttccttgatacatttgggtttaaagccttatacgtaaaacagaataaatgatggcttctaaatacatatacgagaaaagattaaatagataagtagattgattgatcatagatcagtgtaactggaattaattggataatatttccccccctaaaggaactgaagaggaagatgaaggagatgactgtctgttggggtctgtggatgagttctggtggtttcctcacatgtggagccatatgcagccccacctcttccacaatgagtcatctttggtggagcagatgattctcaacaaaaaatttgccttagtaagtaactcactttgttgcattgaagtagtgtacactgattggagaaatgaaaagattcttacattgtggcatagttgcgcttttcagtggcttttccatatgatcatttggaatattttggtattgccgcctttcagtatgtggctcttgagtttgtattgagtgctcaccactatgcttaatgttttgaaggatctaatttgagagggacctcacaaaatacaagatttattatgacattatggtcagagcacctaagacatggctcctgtccagaaggagtttcctgctgcactgagaaggcagaaatatgcatgttaaacaattccccaacaaaatgaaatactttttcaagacctaatgacaaaccttacagccacaaaacccacagttcaaagaaataagtatcactgggagtagcccaagatggattcttctggaaataagattttagatacgtcctgaaataagaataaatcttcgggatcaggattaattgaaatgaaatgaggctgagggaaaagagcaggtaggagaccataatgactgtatgaggtaataaagactcaatctaaacagttaaaagcattgcaaacatatatgctgtatggatggaacatttgtttggctgaagcaaggtacaccatgtaatactgaagggtttatattcaggacagggaaatttatagtaaaagtttaaataagcacattatgaagaaaaatgtgcttgtgatcagagagagtaccgaggtacacttacatggaatggttttctacaccaactgttagaactaagaagtttcagttggttctcacagtaccttactcaaatatatacaagacaaggttagaatgtatacactatattttttttcttgaggatatacaagaccaaatactttatggtggcatcaggggcccatatttgtcttttagcttcaatctactcccccaaataaacaaacagcttcaggtgcacctttgccacatattgatattttgtcaagaaagcaagaatagtgctcctccatgctgatactgtgaaaatgttttgatggtatatgcaaactgctgtgagaaggagagtcatcttttttcctaaaaaaataaacaaataataagcagcatgtaaaattggtaaaacggccccagaatttgtaatagaaagtgctaaaactcatatctcaaaacagcagacattaattctgtcattttcagaaatctagactgttgatattgacaatgttaatcactaataaattatgtggggaaaaaattactttgtggtttacttctaaatctgttgagaaaaagagaaagggatttgtgagagacgaaaatacgtaaatacactaaagtaaagcaccagtaaaagataagatactgagaagtgaggagtgaaattgttgttgttgttgttgctgttttgacagctttccaaaaataatgtaccaaagcagctttgataaaagacatgtcattcactgttacatctgctgaaaactagaatagtatctagaaattacttgaacgaatcaatgaatgccaatattatgtttatgtttaaaacatttgcagatatttggaagtacatatcctaagaatatacttaggctgggtgcagtggctcatgcctgtaatcccagcactttgggaggccgaggtgggcggatcacgaggtcaggagatcgagaccatcctggctaacatggtgaaaccctgtctctactaaaaaatacaaacaattagccaggtgtggtggcgggcgcctgtagtcccagctactcaggaagctgaggcaggagaatggtatgaacccaggaggtggagcttgcagtgagctgagattgcaccactgcactccagcctgggcgacacagccagactccctctcaaaaaaagaaaaaaaaaaaagaatatacttaatacatatgctagaacaggcatgcacaggagttacatgcattttttagaattcccaactaaaaagtatcatgtgtaaaagaataattcaaaaacaatatctggtcattcttaaccacctaagtgttaagcaaagcagatttcttagaagcgtcattcctaactacatgttggcaattcaaattattgtttttgaagcagaagagagtagttgtaatagatcttcagaaataagaccaaatatattatttagtgtttaatcaaatccaggacaagtagaatttattttgttgcaagaggatagatatgaaaaaagactgaatccagaaccagtccctccccagccataacaatatgaaagagcacatataaataaggcatttgggaacagcaattagcatataacactcaatagatggcagctgctgtttttatcattatatctagtatcacaaaattgccatctttaatttttgcccaggctcctgaggtgtttggactgacaggtaagagggacaaaaatccttaagtttaaaagtttactttgtattgggatggcatttgtttaatgtgaattttacccaatttctaaatatgtgttaactcttttactttccattaagcattagggttacaaaactgcattgttgctgactttaaagatataataagaaaagatcaagggtttccaattttaacatatttttattatttcttttaattctcaaattaacccggaattgtaggtctatttattttcccattatagatgaagcaactgagaatcagagaaatgcagtgacttattcatgattataaaactcactagcagtataattaagaccagaaatcttaatgctgcataaattgcagtgttaggtcttctaatgtggcataaagtgtgccccctgccgaggcttcctccctagcctcccaacccaattcacaggtgtgaatcaagatttcttttctgctggtaatccaagggaatatctggttatgctggtaatataaaggaaatggagaacttgaggtggaactcacagggcaacttttccctcggattccctgaagttccctaatataggcagagtctctaaaatgttggagggggtcgaaggggtaggggagacaaaaaactaaatctgaggaaatttccacttgaccaaatatcacttctcatgtgtagttacagaatccactttaattcaatgaaaagtactctggagaaaattctacttcaactcactagatggaacaaagcaaatgtttaacctgtgctaatatggcatttctaaattggattatatcctgctcttctccaccagcttggaggctcttgattttaaaatgagtgttggtatttcccaatgaagaaagtgaaaaaacatgcaaagaagcagtgggctgtcttgggagcaaataggtgttcaaacaagaatggaggtcatggatgcaatattcaaatgggtaattgtgttagaggacatttaaagtacccttccagctaagagaatttccgagactgtgatctaaaacttttgggtttcggcctttgctatcatcatttacagccacatacctgctattttcattgagttttaacaaatacatcttatctattatccttttgcacaatgtggacacatctgactcacaaacaaatttgatgtctattttaatttgtctttgaaagctctaacagtttattatgaaaggtcaagtaaatcctttaagcaaacttgcatttgatgattacacccatcaggaaatgcagctttagaggttgaatggaaaaaatttttagttaccaaatataggataattcaggggttaaactgcaatttcaacaggggatttttttttggaaaggtacaaattctgagacaaagattaaatgtatcattaataatgacctaccacaaaatttaaaatatcaactgtacagtgtgtaaaatagaataacatatcattagaaaggtaaaatagtattctatttaaacctcaaaaaagtcttcaatagtatatactctcaattgaagaactgtatctaaattttggaaaatggtggtggttaaatttttaatgataaaatagttaatagatatttctatcatagaactctgccaatatcagatgatacttaatgcttttatagacaatactattaaaagtagtagtagtagaacaatgttcctgataacataaaatcttactgaagattgaacttctaattgtatcatcatcattcttttaaatggtgtcctttttgcctctcttttccaagtgcagcagaacctgttaatttacattagctggaatgtctattgtcaattataaaactttttagattagtgagcatgttaacttttccaatatggaaataaagattatagtatcaaaatgtaatttaaaatatattgaaagacttgctggcttaaggaatatatgacaatcttttaattagtttgcttgccagctagagaatgaatgaatactaccacttttatttcagtgatgcactttataaaaaggcatatgagattttccttttattgacattgaacacaaagtataattctaggtgtcctaatagagaattccagtcgggttgcaaagagtccactcagctggtaggccactttagagtaattcaagcagcacagtttagaaagacattggccattgttcagagcaaaatgaccaatatgatgaagtctataatttacttcataaaatgaatagctgaaggaaattcaagaaggcaagaggtaaaagagaagactaagggatatattatcagggctactattcaactaagagtactggtatggccatgccagttattacaatattgaaatgtgacaatactttacccctatcctgctaccacatcagattcttccccaaggtgtcccaaatctcccccattactcaggaactaaaggggcctggcccagaaagagtctccagcaccgatctccagctgtccagctggcagcagttctgattggtcagtggcatggcatgctggttggtagatatttttcgttatcattccagaagataatcagtcagtcttaagatttagaagagactagaatcagtatatttataaggaaaagtatggaagtcatatagatttaagaagtagagttcttccaatctagataagttatgtatagagaatggtgcttgacatctagtaggtagtaaatgtttgctaaataaaaataaaagtaaacgtttcttctagctcttaagattctatcattactgtattaaaatgtaggttttattattatacaggtatgatgagtccagtagatcaggagatgactgccattgaaaagatcagtttgttattcccagttaccaagagagggagtgtgccacaaggatgcagggccacaggggaagcaccagggtcgctcaggaggcagagggagcaggggggaaaggtgggcaagagcctttactgtggtttctgcgggaaaggtaaggcaagacagggtaagcaggctcaggattggcgactttgaataatttcagtatgctctgaggtgtaagagctgtctttagtcatctaatacttggatctggggtgattagatcaaagagatagttgctcaacatatgagagtctgataaaggaagcagaggagggtaggagctctgaattgcttgatttacatttgagagtgctctcagggtggtgtttgctatctcttggaattgactagcctgagaacagcaatctctccagagtcagcaaggcccagatatcaaagcatcagaaatacagaaaataaagaggcatgatgctttctcccggttatgtatcttgaagcaattccacaggttttcaaagcccctcaccatcccagctgtcatattcatataatttctaatttgtcgttcttatatcccccaatctgaacattattgtccactgatgtggtgttatcaaagcagaaaatggtaaaatattttttctttcatgtgcactttacttctattaatgtagccaaagatcacattacatttttacaccatcatatcacacctgtgtctgcccgaccctctgtccatgagccatttattaaaccttcaagtatttatttttatccagttgatttttcaaactaaatgctagccttggaattacaattgtccctttaatattccatatttgttatatgttcagtgttttagtatatcaacctcctgctaaagactgactctgttatttaaaatgctttatatctttcctagctttgtgtaatccctatattttacaagtatgacttttgcatcttcaagttattagtattgttgaacatattaatatggttagagatttgtggtagagcaatacatatcctttagctgtgttcccttggtatatttctagcaattgtttcacatctattttttcaccagaatagtttaaaatctgtttttctaaattgaaacatcatatctaattatttttagaattatatattttaagtatcttgaactccaagataacactgtcatctactcctaagttctagcacctccacataggtggcagaatcacagaacattagagaaggagtgtttaggatgaagacaagcaggggaaaattggatgtaagtagacatactggattactaataaattaaccaaagaataggaaataaaacccagctttaactaaaccagtggaagcgggatcataaagaagtgagatgtgaaaagtatttctgacatagattcaataagtttttaatcagatggatgatgaggaagcataagagaataacaggtcaaaaataacattagggtttaagcctcccacttttctatctgtgtgtatctctttaaactttttgcaaaggtgaactgctgctttttctttagaagttctgtatttcacctacatgaggataccccctcttacccatatctacagtactgcaaaatgtattctcatttggatatatcatttgaacttttgaaagtggttttgattggaattcttttctttgtaaattcctgtccagattaccttcttttccatcctatgggaagactccatactctctaacaagatagacattgtagaaagaattcctcaattcctttccctttttcctctaacagaaatactagatttcatcttcaacacatttatctggtaacttaaacgatttcataaaaagaaagataaatttagcacatgtactgcatgaaaatagtgccttactgtccaaatttatgtggacacaaaatgaactaacagcctttatgaattctcctagaaactcatactagtgggctggagtcagatgtgggtatgagggtgggggaggtctatttccagatccattcctgctgctcccgaattttcactgctctttccttttacgcctttcatttacttaagatggagggggcacttgcattctgagaggtggttataaacatggcagagatggaagtgatggcagaagaagtaagagtcaatttcacatgagtgctaaccttggctccgctttggcatttttgtgtctcccactccatgttcccatgcatttaacaatttctttcagttttttctttcttttgtaccagctcctgctccttttcaaaattttccatctctacttcacttccaaattttcagcccacacctagattattgcagcagcctccaaaccagcctccaaactagtctccccaatttcccgtttttttcctttaatttttgctcagatcaggaaacgtgaaacttgaaattctgtgactctgtttccgctgcatgaaacagaaccttacggttcagtgagaaagattcttgactctcttaaggaaatgtaggaagataaattgttgagctccaaaatatttactagacattgcgcttagggctttccatacatcctcggttaattctcccaaccacctgtgaggttgcttattctcgtattgaaaatgaagaaagcaaggcttagagagcttatataaattttccagtgaaagctggagaaagggttttatcccaggtctgtctaattccaaagcccatgtaacaaccatggtttgtaaaattaacaagtagccatgccattgatactgttattgctgttacacagatctcataatcaaaatgttattacttctttaaggaattatatttttacacaaattcagaatacaatctgactttttacaatgtttttctcctaaagagctgtctataggatttatgtagtttcttgtgtttgcgatctcagtgctgcaagcattactgtcctggtggcttttataaataccagagagtatacggtggttataacaaaaatcaatatcaactttttatgctttcagaaatattaaacttcacttaaaattagtactatgtagacttcaagattcctaatcaaccttgcatattttcagggagattaaatgtgtgtgcaagtactctgagaatttgaggctgtcctggattatttatagctttcttacctctcaaagaccccaaaggtccacataaacttcaaactctgagaaagctgaattaaaccaaactttcaattcctccattatgaatccagataattttcttttcagttattttgctacagcataaaaagtaaggcttcatacattcattttttttacatttctataaaccttttcttgtgtttacttgaatacaccccagcaattcaaaaataccaacctgggctgtgcaaagtacaagtgtttacatgattcttttgagtattctcacaaaagcgcatcctttagtgctatgtttacttatgagacactcaacaaagatatgacaacacttcaaaaattctggagggaactctaagagaggaaaacaacatgctcagttaaatgaaaatgtacttgaaataaatgttataattgttagggaagactgggagaaaatcactctcccccaaatatttcttttcttaaaggttacaagtgaaaatgaaaattaaagccaagtatgctaccttttatagccctttttcagtattggtactacatttttagcttaacttttgttactggaatttcttactacgtttggcttacaaaatgtcattccatttcttgaaataatttagctgctaacttgggataatacttaaagaggaatatgtggtgttaagaaggggtttttgcttatgttatttctacagctctatcaaatttatggtacaccagaggtattccttccctcccactttatatgtaatatctaatatgtataatagaagaaatgtatattgtttagtaagactttgtttttagacatgattgataatgacaatgtatcttctttgaggaatgtctgctctgaaataagcactctgaattgtttgagaatggaagtaatggtgagaggagtcttagtttaccttggtttttttgttttgcttgtttttgtttcccccaaataaagaatactgttaactaaataaaagaaaatgaaatggcatttgaccaataactttgtttatatccttcatgctggacaactctgtgagatcattagttttattacccttacttggcaaatgagggaattgaggcacggtgaatttgcataacctgctagggtcctgggaccaatgaagagaagcactgagattgagccggggactcaaatctgtgttctcctaaatctgtattctcttcatgatagtatcctactctctatccctaggattcctggtacaaggaaaatttcattgtcatgggtttggctattttgagatattgaaagaataagactcttttcttactgtatactaaattaaacaccatacactcatctcttttccggagatgagtaactccagagtgataaggtgacacttctgttttataagttgctataatgccattcagttttacaagatctcattattaacacctttaacacttttatccaaagacttttgttacttttattttatagccatattttttgctatcttgtgagacaaagaatatctccttcctcaggtttctggatccataggaatatcactacccagagagactcacctaaacctcaagttccagatttttttatgagggtttcattatataggcatgtttgattgtattattggccacatgattgaactcaatttccaactcctctcgcctaccctaagatcaggctgatatcaccttgctcaaagctctcattctctaattacatggtgggacttcctggcatgactaaccttcatcctgagtcatcttgttagcataaactcaaatataatttcagggtatcaccataaataacaaagacatttctatcactcaggaaattccacagagttaggagttatctcccaggaatcagggataaggaagaccagacaaattctttattaatacaacagctgccaacaggggatgattcttgaacccttaaaacaaatctactaaaaacaacattgtcatcacagaaatttttttcacataccacccagcaaaccaaaatttatattataaatcaaggagcaccatgtaagaaaactagagaaatagttagtggtcaaatctataaatattaaccaaatttatgtaactgtgtctatcatattttaggagattattccatccttaagtatgtagaaagaaaattgtatatgggagtttaagtttgttcatggattaaaaatagtacattcgtatttagcatctgaatataaaatcatttctaaaaccacaaagattatgtcaaagaaacacagaattataaacctggactttagtgactacttgtacaacccctttattttacaattttttagaaaatgaaaaatcagattcctgtgcttaaggtaattaattctttcaagatttttcatttcaaaccataccagaaatattatcatttatcacaggaacatagtctaacatttaataatctttgcatgtagtaccaaatctaaattccctaatctaatgatcctgacttgccttattttgttgtaggctaagaagacagtcagcttcctttgaatagcaactttacatatattgggccactctgccaacatccataccatttcttactttcttccagtgattgcggctactacaggactccttccacaggtgccagaggttccacaggttcttataagctgaattgtggtgtagcccatcagtgtcaccttaggaaaacaaatcatcattagaagcttgaaaatgcttcacaaattcaaataattatataattttgactataatcatcctgttgtgctatcaaatagtacatattattcatgctttctaattatattttgtgctcattaatcatgcccacctcccctgcaacatctactatcctacccagtttctggtagccatccttcgactctctatctccacgtgttcaattgtttcgagttttatatatcacaaataagtgagaacatgtgatgtttgtctttctgtgtcttggttatttcacttaacataatgacctccacttccatctatattgttgcaggtaactgaatcccattcttttttatggctgaatagtacaccactgtgtactattatactgtgtgtatgtatgtgtatatatatatatatatatacacatatatatatatatatacacctcataatatacctcactttctttatctattcatctgttaatatacactggttgcttccaaatcctggctattgtaaacagtgctgcaacgaacatgagagtgcagatatctctttgatacactgatttcctttcttttgggtatatactcagcagtgggattgctggatcatatggtagttctaattttagttttttgagaaacctccaaactgttctccatagtggttgtactaatttacatccccaccaacagcgtataacggttttcttttctctacatctctccagcatttgttgttgcctgtctttttggagaaaagccattttaactggggtgagatgacatctcattatagttttgatttgcatttctctgatgatcagtgatgttgagcaccttttcatatgcctgtttgccatttgtatgtattcttttgagaaatgtctattcaagccctttgtccattagttattcagattacgagattttttactatagagttgtttgagtttcttatatattctggttattaatctcttgtcagatggggagtttgcaaatattttctcccattctgtgggttgtctcttcactttgttgaatgttttgtttgctgtgtagaagcattttaactcgatgtgatcccatctgtccattttttgttggttgcctgtgcttgtggggtattacccaagacatttttgccaagaccaatgtcttggagagtttcccccatgttttcttatagtagtttcatagtttgaggtcttatgtttaagtctttaatatattggtttgatttttgtatatggtgatagacaggggttcagcttaatttttctgcatatggaaatctagtttttcaagcaccatttgttgaagagattgtcctttctccaatgtatgttcttggcacctttgtcaaaaatgagttcactgtaggagtattaatttgttgctgggttctttgttctattccattggtctatgtatctgcctatatgccagtagcatgctgttttggttaccataactccttagtataacgtgaaatcaggtaatgtgattcttccaattttgttctttttgttcaggatagctttggctattctggatcttctgtggttccatataaatttttggattatattgtatattttgtgaaaaatatcattggcattttgataaagatttcattgaatctgtagattgctttgtttagtatggacattttaacaatattgattcttctcatccatgaacatagaatatctttttatttttttggtgtactctttaatgtctttcatcagtgttttatagttttcattgtagagatctttcactttttggttaattcctaggtagttaattttatttgtggctactataaatgagattacattttgacttgttttttacattgttcaccattggcatatagaaatgttactggcttttgtatgttgatcttgtatcttgaattttactgaatttgtttatcagttctaatagttttttggtggagtctttaggtttttccaaatataagattatatcatttggaaacaaggataatttaactgtttcttttccagcttgaatgcccttcatttctttctcttttctgattgctctagctacgacttccagtgctatgttgaataacagtggtgacagtgggcatccttgttgtcttccagatcttagaggaaagcctttcagtttttcccaattcagtatgacaccagctttgggtctgtcatagatggattttattatggtgaggtatgtaccttctataccaagtttgttgagggttttttatcatgaagggatgttcaattttatcaaatgctttttcagcatgaattgaaatgattgtatgatttttgtccttcattctgttgatatgatgtatcatattgattgatttgtgtatattgaaccatcctcacatcccaaggacaagtctcacttggtcatgataaacgatctttttaatgtattgttggatttgcattgttagaattttattgagaatttttgcatcaggattcatcacagatgttggcctgtagttttctttttttgatgtgtctttatctggtttcggtatcaggataatactggcctcatagaatgagcttagaagtattccctcctcctctatattttggaatagtttcagtaggattgctgttagttcttctttaaatgtttggtagaaatcagcagtgtagccatcaagtcctaggtgtttctttactgggagacgttttattatgtcttcaatcttattacttattattggtcttttcaagttttggatttcttcatggttcaattttggtaggttgtatgtgccaaggaatttattcatttcctgtaaattttccaacttgttggcatatagttgctgatagtagccactactgatcctttgaatttcggcagtatcagttgtagtgtttcctttttcatatctgattttatttatttgggtcctcatccttttttttctttgttaatctggctaatggtttgctgattttgtttatcttagaaaaatcctttttgtttcattgacttttttgtattgttttcttcatttcaatttcgtttacttctgctttgatctttattatttcttttctcctattatttttgggttcagtttgcacttgcttttctagttctttaagatgcattgttagattatttatttgaaggttttttcttttttgatgtaggcacttacagctataaactttcctcttagtgctgtttttgctgtatcccataggttttggtatgttatgtttccattatcatttcttttccagaaagtttttcaatttccatcttaattttttcattgacccactgatcattcaagagcatattgtttaatttccattgagtttgtatagtttccaaaattcctcttgttgatttctagttttattccattgttgtcagagaagacgtttgatattgtttagatttgtgtaaatgttttaacacttgttttatgacctaacatatggtctatccttgaaaatgatccatgtgctgagaaaaagaatgtgtattctgtagcctttggttgaaatgttccataaatatatattagattcatttgttgtatagtgctgattaagtccaatattttttgttgagttcctgtctgggacatctgtccaatgctgaaagtggagtgttgaaatctccagctattattgtactggggtctatctctctctttagctctaataatatttttttatatagctgtgtgctccagagttgggtgcatatatattttaaattgttatatactattacggggttgactcctttatcattatatagtgaccttctttgtctcttctcacagtgtttgttttcaaatctattttgtttgatataaggataactactcctgttcattttttgtttcaattggcatggaatatcttttcacatccctttattttcagtctatgtgtatctttataagtgaagtgtgtttcttgtgggcaacagatcatagagtcttgtattttcatccatttggccactctgtgtcttttgatcagagagtttagttcacttatatttaatgtgattatttacgtgtagaaacttactcctgccactttgttatttgttttctggttgttttggggtcgtctctcttttcttttcttccttcctgtcttcctttcagtgaagataattttctcttgtgctttaacttcttgcttgtttctgttgtgttttttgatttgaggctatcatgagactagtaaatactgtcttgtaactcattattttaaactgaagacaacttaacactgattgcataaacacagaaagaaaactctacactttaatttcatcaactcactttttaattttttgttgttccttatgtcttgttgtactgtttatatcttgaaaagtttttgtagttattacttttgattggttcatcatttagtctttctacttaagataagagaagtttacacaccaccattacaatgttatcatagtctgtgtttctctgtgtgcctactattaccagtgtaccagtatttttaccttcagacaatttcttcttgctcattaatatcattttctttcagattgaaaaactccctttagcatttcttataagacaggtctggtgttgatgaaattcctcagcttttgtttgtctgggaaagtctttatttctccttcatgcttgaagaatatttccaccagatatactattctagcataaaagttcttttccttcagcactttaaacatgtcttgccaccctctcctggcctgtcaggcttccactgaaaagtctgctttcagatgtattggaggtccattgaatgttatttgttacttttctcttgctgcatttaggattctgtctttgtctttgactcttgggagtttgattattagatgccttgagttagtcttctttgagttaatctgcttggtgctccataaccttcttgtactcgaatgttgatctctttctccaggtttgggaggttttctgttattcctttgaataaactttttacccttatctgtttctctacttcttctttaaaaccaatatctctgagatttgccctttggaggctattttctagatcttataggtgtgctatgttgttttggtttggtttggtttggtttggtttggttttcttttgtctcttatgattgtgtattttcaaataggctgtcttcaagttcactgattctttcttctgcttgatcaattctgctattaagtgactctgatgcattcttcagtatgtcaattgcaattttcaactctagaatttctgcttgattctttctcattatttcaatctctttgtaaaattaatctgatagaattctgaattccttatctctgttaatcttgaatttctttgagtttcctcaaaatggccattttgaattctctgtctgaaaggtcacacatccttatttctccagtattggtctctgatgccttatttagttcatttggtgaggtcattttcctggatcatcttgatgcttgtagatgttcatctgtgtctgggcatagaatagttaggtatttactatagactttgcagtctgggcttgtttgtgcttgtccttgggaaggcttttcagatatttgaagctgcttggttcccaagcccaatatcactgtggtccttgcagactcgtagaggtaccatcttggtggtcttggagaagatctagaagaaggctctggattaataggcagagattcttgttcatttcccttagtttctcccaaacaaacagagtctctttctctgtgctgagctgcctggaactgggattatgatgatgcaaacacccctatggccactataactgggactgcactgggtcaggcctaaagactcagtcagcacagcactgagtcttgtccaaggcccactataactactacctggctaccacctatgttcactcaaggccctaggccactacaatcagcaggtggcaaagccagccaagtttgtgtccttcccttcagagcggcaagttcctccaggccccaggcaggtccagagatgctgtctgggagccaaggattagagtgaaaaacattagaaatttgcctgacattctgttctactatggctaagctagtactaaaaccatactataaagtacttcctgctcttccttcccctttccacagggagaagagcctctccctctgagcaccaccaccagcagcccttggcagggttctgtcaggccaccggcaattttcacttaagcccaagggttcttctgtcagcttgtggtgaatgctgcctggcctgggattcaccctctgcacagtgggttcccctctgacccacagaaggtccggaaatgctgttcaagagcctaggcctggactcagagaccccaagagcctgcttgttgctctaccccactgtggccaagctggtacataaggtgcaaaacaaagtcccctttacttttccctatgcttttctcaagcaggagtctttcaccatagtcaccactgctgggaatgtgctgggtcacacatgtagtaagtgcgtcccaagtgcccaaggctcacagcatactccctggctatcactgatggttattcagggtccgagggctctttaatcagcaggtgataaatccttccaagactggatctttctcttcaagacaatgggttcccttttgtcctagagtatgtcaagaaatattctctccaggagctagggcctggaatgggggcctcatgactgcctggtgccctctcctactgtagctgagccggtatccaagatgcaagacaacgtcctctttactctttgctctcctcgccttaaacagaaggaaggacgcactttcattgctgtgagttgcacttcctgggattgggggaggagtggcgcaagcaatcctttagctgctctggctagtgtctccctaggtcacatgccaccctagtccactggctctaatcccaatccagcactaggagttgcctaggaattgaagtccttgtgtgctagactgtctttcaagtttaccaaggaccttagagcatgttggcccatggtggcaagacttgacaagaaactcaagctctaactgatgacatgcataacttccccttggctaagtctggtccaaatgatccctccatgtgtgagcaaagcctgagcagagcatggatttgctctctgctatgacagggtagtactgagttcaatgtaaagtccccctgtcactgtgctctccctcccccacataaatagaccctccgcacttcatggccactgccgggagataggggaaaggtggcattggcgattcaagactgtctctccaaccctcctcaatgccattttcattaacttttatgaagataaaacgaggtactgcgattgcttacctgattttttgttcttctgatggtgcttttctgtatgcagatagttgttaaaatttggccttcctgcagggggtacaaatggtatagggttctattctgccattttgctctgccctcataatttttaactgcagtctaaaaattgctttcaagtattatttacatagatattaaaatttccctgatagttaccatatgtttattcttcagacgaacaggcagtgtaatgaagataattgagaaagtgaaaattggaatgagaaggaggtagtcagaatcagatcatactttttcactagtatttgttgagtacttgccattggcaagacactgagtatatcgcagtggataaaatggaacctaaatttcatgaaccttattgtttaatgaaaaagagagatattacataaatgtcttttctatgcaaaaaaatacatgcttacaaactgtgctgtgtactatgaaaaaccaaggaaagctactaagagaagttttaatgtcgacttcatttagattggcacttgtcagtaaagtcttctccaaagatatgacagaataaattaccttcagatttatccaggtgaagatttggagtagaaacatttcaggggaagaaaccacatataggaagatgctgaggtagaaaagtgcttggtgagtttcagggaaagtttcatgtgactaaaattcagtgaaggatggagggtggcacaagataaggctagacaaagaagcaaggatcatatgcagcgcttgcgatcatgctaagaattttgtaatttaagtggaaagggaaatcagggaaagattttgagtagacagtcacataatcatatttgtatcttttaaatattactttgcagggaatgtattggaaggaagcaagagagggaatgcgattctatgccaaaaggcaatgggataagatggtagattcgactagggtgatgataatgatagaattgaagaaaagtagctaaatttaagatatataccagagatagtactgataggacatgacagtggactaaatttagaaaagaggaaagaggaggtgtcaaaactatctatctttcaacacagcaacttgttggttgatggtgtcatttaatgacatggagaaaccctgcagaaagagaatatctggtagggctgagatgtggaaatcatgagttcaactattaagactattaattccacttgtgatccaaatacttcatttacgttttatagttacatagccagattcctcagtgtttttgaaccatgtcctccactagaaaaatcttaacatagatttcagagttcctagatctaagatgctactttcaatcaaggatcaatgaaaagactaattagaattaacttttaaggtagactttttgccacagattaaaaaataatatgtgcttaatctcaaatcgaacaatccagaggagagtaatcagccaaaaatttagcatgatggctaaagcttttaaaacctgatagtctgccttccggatcacactacctgcaatcttaacccaaacttttctatacaataacgtttcaggtgttctctctggtgatgaatgcaaatttgggagcaaatttatgttgccttcttctaaaatgaatttaaaagcagccccctactaactgaatgactcacaagctggaactactcggcagtggctgagcatatttggaggaatcagaagagaagcaggcttaggaaggggtagtggggtagaagtcagagttcaccacaggagtctcatgagaaagaatcccaaaatctacagtgaaagtagaaaatacagtctgtctcttttagtggaaaataagtggcccagtagtttcataatttccacattatacttgagtggtaggatcatagcatctaaaaacaatagaggcagggtagtaatgacaacaataattttaaaaatccattaaatgcatatcatgtttccagaactatactatcttccaaaattacctctgaacccctttgaggtaatgcccttatgactagcattttagagaacaggaaacaaggcttagagctcataggtcatttgccaaaagccatgcagttggtgaatgagagcatgaacagccagatacgtctgattccagaagcgatgttttctgctactatgccacactgcaccagcacacaaataaaagatgaaactaaaaaacccatttagtcaggtgtgctggtgtgcatttgtagtcctaactactgcaggaggattgcttgagcccaggaggtcgaggatgcagtaagctatgatcaccaccactgtacaccagcctgggaaacagtgagatcccgtctcaataaattaactaattaattaaaaattgcagtagtttttagtgttaaagctaggaaaaaaaagtaaaaactgtatatacattggttgccaaatatttttaaatccaaaataagggaaatgtctctgctatgctgggccatcctttcatgccatgtgggttctgaagacacagctgactactcgccgttattgaaaactaccttgagcttttgaacagcataatttcttacaaatttgcagatgcttgaattttataacatagctcttgtcattgtgtatttcttcccacactcttcaaaaagttgttaacctcctcagcaccacataacatttccatgtaacaaacctgcacatgcacccctgtatctaaaagttgaaatttaaaataaaagaatactatttaacaaccaccagaaataataaagttacttcagcacattttttaaagttgttaacctataattcattttttaatgtttgtgatatgaattcatttttcttcatctggtctttatcaccatacccctagccttcaatcactttagttgagcacaaattatgtgttgataagggatgtctagtgggaaaaaattagtttagtttgagtttttaaaaaccagtacgaaaaaagcaatgagatatttcaattcaatttttagtggagttctaaatatgatggttatgtagttatggtaatttctgcaaatgatgcaaataaaatgaagaatatgaaactttacctctcacccttcagaaacacaggaatggtccactcaacctccaataccacccatcctctttctcacagtagcaagatagtggctcccgtttttggcatcctcaactacagctgacggaactgagttttgaacaataaacagagtttacgagataagaaaagggcattccaattgaggaagacagtgtgtacagtatacagcaatgacatgaaggaaatcatcagaaattggggcgatgagtgctgatagaagatgaggctatataggtaggttgggaccaaattttgagggccttttatgctgtatcaaggaatttgaacaagtatttaggtaatggcaaaccactggcaagctgttttctttctgcattcaggcacttcatatactttcttcccctcctgttcttatttaggtttaaaaacaaagctaaccatacctctaactttttccatatcagttggctgcatatttctgcaatttaaaccatttagcagcctgatactatgattctgtgtatgtgaaactgttatttggcatgaagacagtcattaatttaaaagaacctatttgagtggaatttttgaagattttttccaagcaattgaaaaatataaacagaaaaataaaaaataactttggagaaaaaaatacctgtcaactactgaagccatgggtgttctatttctaaaagacacgtttcattttgtattactgtgtaattttcctctatgcctttttttttttaactggagtcattttatgtacaagagcttgacttcaaatcaactaagttcccagaatatttggctgtttcagtaccttcaactttcactataagggcttctacttcaaaaaaaattactctgttgaattttaccacattatccaatcaaaagtgtgtgcttctcctaaggcagggaacgttgttactgctggcccacatgctgaaaggacaacagaaatgtggaaaacttggtagaaactgtagagcagacaaaataaaatcttaacagcagcctaatgaacttggaaggtgttctgttcctctaataaacattggttttattttgcgggaagtgcttagttttgtttgtaataagtgtctaacatttaacttgttgacgtatgggcaataggaaaacaggtggctacgacaaggatgtgcaaaatagaggctctttcaaattattcattaaaatcactagatctgtctcaccacccctcaaacacagatgcatcaacataaggactggtgaaatggctaacaggcttcatgacgtctagaggtgttaatacttatatcactttaattttaccacacaattaagtaatgatgcatttaaatatatatatttacagtacatttgaaaatcttactgtaaaaataggatcaagataaatctttacacgctccaattaacatttgcttggtcttaggagcacggcattccaacggacatgggctacgctgtggcccctcaccattcgggcgtctaccctgtacatgttcagctttatgaggcctggaagaaggtctggaatattaaaatcaccagcactgaagaatatccacatctgaagccagctagataccggaggggttttatccacaaaaacatcatggtgagcttcctccagtatgcatagggtacaactaattctgcaagatttcattcctcacttgaagaaagaaaaacacaaatgttagcagcataaatgtaggaaaagctccatgctgcaggaagcatatttgtcatatctaagcagaaaatgttttaattaaaatcacttcttttcaattcttcaaatataactgaaaaaggttttgttactgacattaccactggtaagcaggcactgatgttaaaatactaaaaaaaaattacatttaacttgcagataatttttagtagacatcacttcttcaaaatgttattcagtatgaaaaactaacaccaactctgtctatattaaccatgctgctctttgacaagccagtcaaactgtgttcttctatttaccatgccaggctaaaaaagaactcaaccatttgcagccagaagccacatgtgaagccctgcataatcattaacatataataatatagagtaaaaatgacaggtgatgctaattaaatcatttgcatacaccatctaattctatcctgggcttctctgttttgttttttacaatttcagcaaatgtatattgtcaaaatatgctactacctcccaaagtaagcaattaaatcctaatttattcccaaatcagaaaatcctaagaaagtcctggtaaagctaggaatgggcctcctaatttagaatcacacactgggaagaaacaccacagaagaacactatgtgatgagccaccgtaacactctgttgaactgatatgtctgaagagatgtttaccctttagaattaggttataactgacttcttttcagagagtttttcaatgtctgcaaaaattacagagtggatagacatatagcttagatcatctcccatcttgacttttccctcaataaaaactgttgtaaatgctagacggggacataatggccacattttatcccaatctgcccttcctctgtactgaaaatgaacctactgtggctcaagctgccagaattctgaccagagggagtttagaagacctgggatatattttttcatttctcctgaaaacacatttttatctgtattataaatgcatgaatcatgcaggtaatcaaggctctaacagatttcctgttttgatggaactgtccctgtggatctgcttttgcagcaatctgtggaaacctatatttggcttgtgggctcttggatgagagtttccaagtgggaaatgttcagcagacagttgattacacaataagcgagagaaaataagactaggagccatccaaatagagaagcaagtagagaccacaggagccaatatgccctcctagggagagaatgcatctagaaatagggaactgaggagtgaactttagatcacactcttattttgctgtatgagagcaacttttttctgatgatccattcccaaatccaactcaaaaggtctcattatcttcccttcgaaccggctattgattgtgccattatccttaattcagttctgtaattcaaacatcattctatccccctaccaccacttccaatcagtgtctatatttcatcaataattcctttatatcttttttatttcctttcccactgccaccatcttaatttacttccttgactttcatgtgtgaacctggtgctgcttcctactttatctatttacaggttccatccaccacctcactgcagtctatcccatagacagtgccaaccttttaatctttctaaaatgctgcctttatcctggccttcctaaccttgattagttccagttgcttccatatcccctaatgtgcccttcaggtacctgaaaaccatctggactgtctacctttctatttcctatttccctatggctgaagcacactcactccaaccaaaccccataatagtattgctgttaccatgcctgtgtcattctttccaccttgagagactttctggccactatctacctatttctattccctttattcttcaatatcaaatcccatatcttaaataattgaaaacaaagcaccttagtatatagcaactcaatacctaactcatacctacagggatcttattctcctctgaattcctacaacacatcattttgtattttcatcaggaacataaacaccaattacactttaagctgtttgagccctaaccaaagtctctggacccctagttttattgcattttcaactgagtcattttccttcagccaagacctgatggaaaccagcactctctactctaatctctggttgttgaatatgactctctggaaagaaccagtatattagtccattctcacattgctatgagtaaatacccaagactgggtaatttataaaggaaagaggtttaatggactcatagttcagcatggctggggagacctcaagaaacttacaatcatggcagaaggcaaaggggaagcaaagcaccttcttcacaaagcaacaggaaggagaagtgcagagcaaaccgggaagagccccttataaaatcatcaggtcttgtgagaactcactcgctatcacaagaacagcatgtgggaaactgtccccatgattcagttacctccacctggtctctcccttgacatatgagtattatggggattacaatttaaaatgagatttgagtgaggacacaaaccctaaccatatcagccagagacctctaaaaaattagactacacatcctatctacttactgtttttaatggaaatgcccattggtagagactcattaatcctgctgtaaaccctctaagtggtctttattggtatctccccagaagtatttgttggcagttgctcctgaatgagccttaggtacaggatattgacttcagtccacattggccaagattcttgttgatcatggctttcataataaactcctagctattttcagcagcaatagggttctcaggggttcatcggcatctcaaagtttgactttgatactgttacattcccagaaccaattctagggggcagtccacagcagaatgcctaaaaatgtttctcatcctttccgtagcataagaaagctgtttcaaggaacatgctcatcattcggtgccactgcatttatggagcaaggcagtggaatatgacccttatcacactcctgatcatctccttagcctcctgtagtggtccactgactcccgctagggctctctatggggttcataccctcagcaggagtagtgctcctgcagttgcagggtaaagcctgccacttcctcttcactgcattgaaattcaaataatttgagaaatagacaaaattcaaatatctttttgcttctctcttcgttttgcacagaatcagctaggcaatcaagtcccaaagatggctctgtatatatcctataattttccaagcaaaatattcaaactgaaccctagaagtgattcagtcatagtcatacacttttaaaatgttaaatgccatttaacacgtgagcattttattatgtagcttttgggtctttcccattaccccaatatagcttaaatccttcaagagtagaaaacatatatctttctgttctctcacatgggctggcatggaactaggatatggatctagtattctagcataaaactaactccatgcaacctattaacatacagtccatagctagttccactagcacttaactaaatctattctgtgggctagcatagagtttagaataaatatttgttaaataaatgaataaatactatataaagtatttattccaaatgctttccaaattcaaaatttcatttttaatttccaaatattacatttataatagttgttaggaaatatatttaattccattagaatgcatttgcatttagttgttttttgttattatttttgtgtatagataggatcatgaggatgcataatgcttttaaacatagacatcatcagagctaatattttatacttaaacagaagttttttaactattttattaagataaaatagcttctaaggatataacttctaccaacttaccaaaataaataggatatatagagtttttatttatgcagatatactgattgagctgtctgtccaaggactagattatacaataggttgtattatataaccagtattatataatactatccaagggctagacgaaaatttattttaatacacattcaaactaaaataaaaaataaaaataaaataaaataaaataaaaacactagtatatttctacagggttgcaaaacatgggaagtcctggacaggtaatattttgaaagcatttactgaaccaaatgtgctttaagactcaagacataaaacatgaagattgatttacttaggacaataagcagaagacctgtccctatatgattttgtaacatttgtagctctctgaagtatactcattaatgttctgctacttcaaatgtatagtgacaaacacaggtcaccatgaagtcattgtaaaatattctgcttaaggctttattatcttgcacaactttaattcacaccttcttttataattgcaaaaggctataaaaatttgaaaaaccttatcacgagtgtatataattgaagcagataatacatatatacaaaggatgaagagaagacctcttactaaatgaccttttatcattttgttgttacactttctaaaagtaacaaaccaagtgaataatctctttcttacagtaggaactggcaggcttcacacttagaatctgaggtaattactatagcctgcagtagtcctttcagacgagaacagatactgtgatttgtgtctcaaatattcattctaatttaaaatgtcattccctaagaagcacattgagttgataactgacttcattttctaatgcatggcagaatttggcagaaaatattttcttaaaattattgcctattaagattacagtatagcacagacaatccaatactttttttaaagtctcatttttacttctttttttttaatctcttaagatgctagaacctactaggcttcataaaagaagtactcactttgatatttaaaacagacaagtagctaaaataacacaacacctattttagttttaaaatatttcttcaactttcttcactattccttccatattaacatcaccttcccttgcctagagtatgatagattgtccaggccctggttagacctgaataattcactagcttgtgcatcatcttgtgtgagcaaaaagctaagtttcaacaaattgattggaaaaaaaaaagcttttccttacttttttcatttttccttcaggttctcccaagacaaacctgtgggcttttcactcacaccattttctacaaagaatatccagggggtcctaaagagctggataagagtatccaaggaggagaacttttcttcactgtcgtcctcaaccctgtaagtactttattctccaaataaatagtgaaaaatgatagggctggcaaaaattaccctggcaaagaggctagggattgggcagtcatcagccaagccaatatgaagttctagctctgaaacagtagtaaaaactaaatggaaccacatctagaaatgggaacaaaccaattctacaagtagcagtaacatgaggaactcatggcagaaccagggaagtgctccagcggatcctcctttgcattgcaaagtgatcagaagctttcatggggaataaaatttttcacctgtaaaactctcctatttccacggggaaccatttttttttccatttagacaacagttacctctattattatttttattttactatttaaagttaacgtagaagcaaaatagtagaggaattaggtaagcaaatctagttatattttctacttcatgttagattcgtcttgctaggtcataggctgaagcagagcaggcctatttaatgggctacttttttttttttgagatggagtctcactctgtcacccaggctcgagtgcagtggcgccatctcggctcactgcaagctccgcctcccgggttcacgccattctcctgcctcagcctcccgagtagctgggaccacaggcacctgccaccacacggggctaattttttgtatttttagtggagacgaggcttcactgtgttagccaggatggtctcaatctcctgaccttgtgatctgcctgcctcagcctcccaaagtgctgggattacaggcgtgagccaccacgcctggccgggctactcttttacttcttcatacttgtgtgtcagctccacaatgaaccatttgcatatatttctgcttgaggcaagtattagaaagttgtgtagagaaagaacaaatggaagtaagctgcataaggaaaagaagggattttatttcccttttgaaaatcactatcataaaaagtaaagctaagtttatttatcagaagatgtatgggtttgcccttggcattggcaatattcaagatggaaaaaaaattattatttccaaatgtaaaaaaaaaaaattatcagtgaaaaaagttggatagggataaattgaataaaatttgcaaaacccctctcttgaccttagttttatagtccctgcaaataaaattgcagatagtgttcaccatctacttgtattcaaggagatttattgtgctcaattctgcttgtattcatcactatacctatgttttaactcctagaaaatgagatagaagaaagagtaactcatctttggacaaaacctgctcgtgtattcaaaaatggggatagtttggaggaatgtgatatttggacttttgaaagtttatcaaccttcagatcccaaaaatacaaataagtctggtttgaacatcagaaatataataactcttctaacttacctattttcacaaatggaagtattttgagtctccttatacagctttcttctcttttttctcaattcagccagtacagtaatatacagtcaaaaagagttaaaccaatgcctggttatgaactgaagaagcagttaaaacactcttaaaatgctaacattttcaccaataattttaagcactttaatctatcatctgtaaaattctgatgtttcacatttactttcatcatagagcaacagaagtattaacaaataatcatgaacttcttaaaagttcacagtaggattttatctccgaatttctaaaccaaatgagtttcatttagtgtggaagaaattcaaagttaaatcattcatgtacaatggatttatactaagaatttcatccattttgtgataagaaatattacattttttattaatttaaaaaccaaactattgtctttgtttttaaaaaccttacagtaaagtttatgttaatcttggacactaattggactaactgagcaaattccttaacaaacctcgctatttttcaggcctttatgaatgatatttggcaattttatgtcttgaggaggagattcataagaataaaggtggcaggttgggggagccgcacaaaacttgttctttcctgattcagaaaactttcagtagacaattactttcagaaaaaaatccctagactcaaaataaatgacaaatcttgtcagatgccacaagacagacaaggaacccaaagctaacgttatctggcacaccaactctaatactggaagcaattctactcacctggaaacaaaaggttaagaagcccacatctggattcagcccacatctagccggaggccggactactataattagttagtgatgtctgtcttggagaacagagtaaggagtagtggcatgtttcccatgaattctccatcctgaaattaagtgcttggacaaagtttgtattgaaactaaggaagatccagatgcagtaaggcatgccagtaatttagcagatgacattttttattaggccaggatggaaatgagaaaaccttgatggaatcaaagtatacattagctgcaggaaagtcatgaattttaattatagtggatttgaaagatagccattgtaagtttaagtaataccccaggcctcaattagaagtgccattttctgagaatgccaagtgaggttatcgtttactacaaaaagatagatgtgtattggaaacatggcacttaaatacattcacatacatttgagctgaaaacaaaaatataaacaggactttaattaatgagggttttaagtttttcccatatgtcaacataatatcaaggtgctatactaacttaccagtactggggtgagaaagggttacaataaggtgcccctcagagttaaactggaaagatcacagcaaaggtaaaaaaaccgttaaacagaataactctctggcctgaaatgttctaatgttaccaaaatatttgtcatgtaaaagaaagaagtatcaatcaagtgaatttaacaaaatagagaattacaaagacaaatgttagcactgtctggggaagagaaaactttggtcatctctaaatgagcttttccaatgtcacaggcctggacaactctcacgtaagctggatgcaggggttttgattaatagactttgaagtttagatccatttgggggaggtggacctagcaggctatctgagcctggaaccattgagatttccatttttctaatactacttttcctgattctaaacccaactgatgacttcctcattatggtttactttcccacgtagatcctactataggaaaagaatatgttaatcataggaacttgtactctctgggacaataatttgcaatataattttataagttttattttaattgatcaatacttcccatgtaaccggactacctggaaagagccctctaattgtatagacagtaattgaagagtatttcagttcctctctaatttataattacccattttaaactaatagatggtatcctgcttttattcattggtttcatgagcttttgctaatctgattctgccccagaaaaatactgactctctctgcaagtgtactgaatcaggttttggagcctgtcggtcagaaacagacctcagagtgttcgttgattaaggatggtaatgagagttacctcatgatataccatgggagagagccactggaagtaccccagagtcactgctagcaacacacaggcatgagatttctacacaaacatgtaatatacctagatacaaacattcttgatcaatttacaattatacagagtactcatatatattttcaaaaattgtgatattctatttactttagatacttatataaaataaaatgcagaagggtactaagaactgaaacttatgaagataacaaaaaggattaattggcaatgactgcatctgccctcaataaataaaactctatatatgacgtatatacttagacaaaaggaactagtacgactatagtgttcattttaacaagtttccagttccacctatcttaggaagatgcagtaatagttaattaatatgctgattggaaaagttccggcttagacaggtttgtacttcttgtgggagccatattatcatctcatatgcactaaacaaaaatgtcacttttttgcttcagggttcttatctctaatcacaagatgttatgagtctttgcttatgcacttgttgaataaatagactccaggtattgagtcattaacaactatagatatagaacactttgcctcccttcaacatgcttgataataaagtcagtgcttacctattaatccaaaaaagcagctgtggattgccacaagattcatgccaatgggccaggcgcagtggctcacgcctgtaatgtcagcactttgggaggccaaggtgggcagatcatgaggtcaggagatcaagaccatcctggctaacacggtgaaaccctgtctctactaaaaatacaaaaaattagccaggcgtggtggcaggcgcctgtagtcccagctactcaggaggctgaggtaggagaatcactggaatccaggaggcagaggttgcagtgagccaagatcacgccactgcactccagcctgggcgacagagcgagactctgtctcaaaaaaaatgcgcgccaatactacacttgcttggaattcaggtgaagcaaatccctgaccatgtaacaatattgtgcctccttcatcaaaccattaaccatcccacagaaccattagctaacccctttatgcacgcattttattaaatgctttttgtctctctgtttctcaatttgatatagcatacttccaccataccctacataccctcctactcaaatccctaaaagttaaatctaaattgtgtttctcttattataaacatggatgtgaatagagtgaatatcttaaactaggattaacacatagattgattacaactaaaataaataaaacagaattcactcaagaagaaagcctttataaaaagaaattaacccacattgaaattgaaaaaaaatactgtaattttatatgtgtatgtgcttttctctaaaattcatctgaaaggaaataatacattgacctaatgggaagttttatgtttctttttttgttcgctagttctggaacacattctaataataggagacccttcgctgaaaaataaataaatgataataactttagacctagaaaagtaattcctggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcagcattatttctgagggctctgttctgttccattgatctatatctgtgttttggtaccagtaccatgctgttttggttactgtagccttgtagtatagtttgaagtcaggcagcgtggttcctccagctttgttcttttggcttaggattgacttggcgatgcgggctcttttttggttccatatgaactttaaagtagttttttccaattctgtgaagaaagtcattggtagcttgatggggatgacattgaatctctaaattaccttgggcagtatggccattttcacgatattgattcttcctacccaagagcatggaatgttcttccatttgtttgtatcctcttttatttccttgagcagtggtttgtagttctccttgaagaggtccttcacatcccttgtaagttggattccgaggtattttattctctttgaagcaattgtgaatgggagttcactcatgatttggctctctgtttgtctgttgttggtgtataagaatgcttgtgatttttgtacattgattttgtatcctgagactttgctgaagttgcttatcaacttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgaaagagggcatccctgtcttgtgccaatttttaaagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattttgtttgccagtattttattgaggatttttgcatcaatgttcatcaaggatattggtctaaaattctcttttttggatgtgtctctgcccggctttggtatcagcatgatgctggcctcataccataaaaaccctagaagaaaacctaggcattaccattcaggacataagcacgggcaaggacttcatgtctaaaacaccaaaagcaatggcaacaaaagacaaaattgacaaatgggatctaattaaactcaagagcttctgcacagcaaaagaaactaccatcagagtgaacaagcaacctacaaaatgggagaaaattttcacaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatagcaatcattcaaaagtcaggaaacaacaggtgctggagaggatgtggagaaataggaacacttttacactgttggtgggactgtaaactagttcaaccattgtggaagtcagtgtggcaattcctcaaggatctagaagtagaaataccatttgacccagccatcccattactgggtatatacccaaaggactataaatcatactgctataaagacacatgcacacgtatgtttattgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatgcatgaaattggaaatcatcattctcagtaaactatcgcaagaacaaaaaaccaaacaccgcatattctcactcataggtgggaactgaacaatgagaacacatggacacaggaaggggaacattacactctggggactgttgtggggtggagtgagaggggagggatagcattgggagatatacctaatgctagatgacgagttagtgggtgcagcgcaccagcatggtacatgtatacatatgtaactaacctgcatattgtgcacatgtaccctaaaacttaaagtataataataataaaaaaaagaaatattaaaaaacaacaacaacaacaaaaataaaataaaataaaagtaattcctgaacatgcctaatagtgagtactgcctgagatgcttgaattttagaaatcaaacttaatgcatcagaatctctaggattgacctaggggctctacatactcaccatgcgctttaggtaaatgttaggatcaggcaaatagagaaatattgccgaggaagaaaatggagaagtaattttggtaatcaaagattaccaaaaactgttatagaaattgtaaacctagaatcaaggtttcagaatggaaaatggctccaaatctgcaatagaactttaaaaaacagtaagaattaatgttttcctaagtgaccagagaactctaccttaaactggattttaaaatagtgtttactgctgttcatcccaaaaacttagtgtaggggtcaccttcctcaggaaactttttctactctgatttagaggcccctcctgcgtttctatagcatcctctgcagactctttcaaagtatttattatcctgcatcataattgtgggttgtattagcctgtacgcttgtggttgtagagaatgtgtctgtcatttccaaaactatcccagtgtctaaacataatatgttttacctagttttttattttgcatatatttgttaaggaaaagaaattaacttttctaatgaactgatttaaaaagaaaaatgaatctattcataaaaggaaatccgagtcctcgtaagaaaattctcaaatcaaaagcataaggaaaacctgtttcctgaattcactggggctgaattatgtatcgttgtgttctgttctttacacatgcatttgtcttcctgtatagagactcatttgtgttgagttgatatagtttaaagactagaggctcattcaagttacctcaggtaatgggactccagaaagtaatattacttcaagtaatgtgggactccagaaagctacacattcaggaatcataggacctagagggtgttctgagaccaaggtagctgtaaggtccataaaaatcagaatttctttaaaacttatgaattgtttattattgaaatttttcatttaatttttctggaccacagttgacaattggtaaccaaaaccctggaaaaggggcctactgtaaatatttttctgatgaggtcgctttacttacaatagaaataaaactttaaacaaggtaaagaaaaaaatgagaaatgctaatattaatcttgccttagtgctttattttgaacccaacagatgcttttcacatgtctaactttctcttttctgtactcctgactaaattaatattccttcaaaaaaagtgctgcttgtttacggtttctgcagtagttaattaatcttacaaatggcccaatatgaatgcatcagatattctccatatcaagattcagctccagttctaactgctgactgcctcgtccgctggattctcaggtcgaatttccaagcaagggaatccacttgcttcagctcacctttctgagtcagcccatatcagtcctggccttctgtgaaatgtccattcttggttcatatccccacatgccccccacttctaaactatgactgagcaacggctacctgagaaccatccttccagcaaaggcttgcaaaggcaggtgcgatggcagctatctatcttgatctgaatcctgtgagaacagtcattatggtttctagccaatcccacagatttgggagtaaactgaacctctttggagaggctcaaaagattcattttgaagcttgcaaagtctaagtagaataagtagctctcttagatgggaccagctaattttatcattttattatatgtattgctccatacccacttggaatgcaagttccaataggcatttatatcttgtgttttgtttactctaaacctcaacactaggaagagttatggcattataaggtacttaaaaaatattttataaatgaatgaatgaacttaaatgtccaaaagggagcagcggagtggccagtagcaaaataaattatgttcacccttatgtaataaaatacattatgtaataaaatacgctatataataaggtacattcaggcatttaaaacatgttgtgtaataagtttggctgggtgtggtggctcatgcctttaataccagcactttgggatgccaaagcgggtggatcacctgagttcaggagttccctgaccagcctggccaacactgtgaaacccagtctatactaaaaatacaaaaattagccgggcgtggtggtgcatgcctgtaatcccagctacttgggaggctgaggcaggagaattgcttgaacccgggaggcggaggttgcagtgagccgaaatcgcaccactgcactccagcctgggcgacagagagagactccatctaaaataataataataataataattttaatgacgtgaaatattcatgatcttctcaatgggaaaagtaaattacaagaaaatgagatatgagtatggaaataaactagaaagaactcagcagattgttagcagtagttatcctagatcacacaattgaagatgatttccattatcttcctctaatttttataaaatatctatagtgaacacctattagtgttataaccagaaacttcatacacatgtacacacacagagacacaacacacacagagttacacaataaatgctacactaaaaataataataatcacttaatagtgatgtacataaaatggaattattttgtgttgttggtatatcaggaatagaatttctatttactcagttccaattgttctgtatctgtaagtcacatatgttgcctaacacctgccccacagtgtgattatttgtgtgtgcatcttttctactgtataatggggcattcttattacagaggtaatctgtgtgtgtttcatctttgtgctttccattgtgtctagatcaatgtttgaatctaataagaggttgctaaatgtattttaatgattgactaaacgcatgaagagttatatttcaggggcatgacttgctttaaggtatatccaaatgtgaatagcaagcctagttttaataaaactacatttggcagagtctctgcttgcaagtaaatgaaatttagacttcagaaaatgtttgaatggccctaaatctttagcaggttttcataagtgatgatgaaatttacctgacacagaacaaaggactattaaactggaaaagaccaggaaggttatctatcaatcttttaatttttgatggagaactagaattccaaaaagattatttagttcactgcaggtcacttctatagtattccgaccagaactctgttcttcctgactctcagttcaccacttcacccgctacaacacactgtttctgcacgcctggctaaattggtcttgacgtgatgtacattccttcttaatatgagtcagtgacctggtactgggaaaatctgtgagtggtttaacatgtcaggctattgtctaagaaaaagcaaaccatctccatgtagggttaaaaagcaaaaaaatagtgcttttgagaaaagctgtaataagcacttgcagttaaggaaaaatgtctaatgtacttttaaagaactacgaataaagaactatgttctctttatcttaatacattgtattgatattacttataaaatggtaagacttttaaatttataaagccaaaacattttatttcatctttttgctatcctccatattagccctatttttctattattaatgttcttcatcactaactgtggtgttagatacagcaggtccttaaataatgttgtttcatttaatatcatttagttataatgttgataaggaaaacatcagttcccatccagggccaatctgtgtgtagtttgcacattcaccccatgtctatgtgggttttctcctgatactctggtttcttcctacatcccaaaaatgtgcacatcaggttaattgtcctgtataaattgtgatggaataccatattgtccagggttggttcttgccttgtgccctgaactgccaggataggccctggcccccaagcaatcctaaactggaataactgggtaaatgattatcttacttgtttttattactctttcctaaatatatgtagagctaacatttatttcaatgtttaatattaaagttctttggttcctatttagaagctgggtgatgttttgggggccagaaatatgtcataggaaattaactcttgtttagattatttaaccaatggtaaaattggttttgttatatgtcatttggtttacagtttcagtttccaagaacctaccaataacattaagtgagaacttactgtaattacttgtcactctgagattaagaaaaccacaagaaagcatgattaagttgtgctttttatttgacctccatagttaagaaaaataggagtttttggaatggatattatcttaaaatgtaagaaaatagatattaagttggagaaatgaatattatgttattctttgttcaatcctttgatagtttcccatagcaatcaatgacacccagtagcaaagattttaattcctacatactaaatacaaagtgctcagattttaattcctaaatactatttctagcattcaggatagacagaaaatttcttcacttgaaaaaaatcaaatctggctcctgtccacttttctcatcctttttttcaataatttcttatatgcacctttcactccacccatacagaataattcatagtaccttgaacaaaactttgtactatctcactctatgtcttaaagtgctatcacctcaagctggaatgccctcctgcaaatttgaactcatacatcatttttttaaagaagacatccccaaccctccagcttgatttctaaggtttctcctctgtgttctcatggtactcaggcataacccaattataatttgcctacagtcctataatcaattatctttaccttccagtaatttttgacttccttgatggaagacatcatgccttattctattttacattcacagtacactgcaaaagttttggcacatagtaggttctaaataaaagacaatgtgtttcccatgacttcccatgactacatacatactatctttggaatttgaaagaaatttggttgccttggaagtacctcaccacagaattcacttgattacagagggtttgagtaactggtttttattgtctcccaacatggcattttattgaagtcattgagtttatgagaatatgctcagtttcactcataataagaaaaatgcaaagtaagattatattgagacactatttcttacctaccagattaacaaaaattcaaatgattgctaagatattctgttagcaagtctgtgggaaaacaggtactctcatacatcctagtgcgtgagcaaatggtacaaccctaatggaagaaatttaacaacatctaacaaatctacatagcacttgctctttgctgcagaaattctacctttaggactctaccttaaagaaggaattaccacaaagtcaattttttaatgaacaatctgagtgcaaaccattttttcagttattcattaccggattatttgtacatcaaatagtgggaacaacctaaacatccatccataagagactagttaaaaaaatctgtggtatagccatacaagagactactatacaaataaaattaagaagattttgatgtgctatgatttccacaatacattaagggaggaaaaagtgggcaatctgaatacatattgatatttacctacttgtacgaaaagaaatacaggaaaaacacaccaaaaataataaaagtgttttgttaattattaatagaaattttaaaaatttaaattattaataaaaagaaaactacatttaaaatggggggatggtgggatgagagcagaaaagtaagggggtgagtgggagaaacacttcactacgtacattttttacacagttttgtttttgtttttttttttttttgagacagagtctcactctgttaccaaggctggagtgcagtggcgtgatctcagctcactgcctccgcctcccaggtagcagcgattctcctgcctcagcctcccgagtagttaggactacaggtaggtgccaccatgcccggctaattttttgtatttttagtagagacagggtctcactgtgttagccaggatggtctcgatctcctgacctcatgatccacccacctcaacctcctaaagtgctgggattgcaggcatgagccacctagcccagcctatagctttgattttgaaccatgaaatgttttacatatagtcaaaataataaatgaaaaggatgagggagagataagcaaacctgaaaattgaagacaaatgaacaaataaacctaacatggatgtgtatgtaatatattacacaaaataattaattaaaataattttgagtacagtattctaactgcatacgtttagtgaaatataggacaaaagtctgcatggaaaatataaactttattaataaatttttgttgaattatgaaacatttctcatgtattgtcagatagaaaaaaataaatgaatatattgatgctgttgggaactgagttttcgccataaaacgaataaaaatatggaaagaaggataataagagagaattagagtatttaaatttgaaatgaggagattaataagaacttaaggtttcctacctctatctagaatcaatgacacttagtagcaaagagctcagctagtgctcaaattttaatttctaaatactatttctccccaaaagtaagtgggctttttggagaaaaggctaaattcaagtcagatacatggaaagtacaaattgagtctggaacaccttgtaccagaaaaaagggaaacagtcactcaaagactaacaagcttgtattaaacaggacagaaatcagctaaaagtgctcttgatatgagataattttagcatgaaaaaaatggaggttatagacatactcaaagtatgaaaaaagaaggagagttcttctgtagaaaagacaccagtgccagctgatgaattcaggtagaatgatggaattcaaagatcatcattttgcagacaccaatgaaaacaattgattgaaaaaagaaacatcaatagttgctgaaacttttgggtgaaagattacacagccttaaggtttaattccatagattacttattaattacaaagagaaaaatcattcttcacaatagagaaatctgacagtttcttactgtacccaagtgatcagacttaacatcaccaaaggtggagtaacttaacaagataagctgatattatgcacctcctgtgattcaatacaaaataaagtagggtgacatcagcaaaatgatgaaatagaaagtcccatatcctccttccttccatagagtcatcaactgaacaacaatacatgaattaattccctttgtgaaaaatccagaaacaaattaagacactgctggaccccaggcaagcgcaaaaccagctgcatagaggccagtaaaaaaattcacaacactcacttgccatagtccctttcactgactcagcagagagcaactggaagaaaactcccagcttctagcttctcccacagtcccataggaggaaaagatttggcttgtacatttttgtacattgaacatttaggcttttggcaggggacagaggggcagaagggtgggtggatggttgcccgagaaactagtttttatcttatctgtctccaagtgctgacaggacccaatatattctagaagccaggggctgctgacaacaaaagacagcttggcagcttatagcagctccagagaacaccagaaggagtaatagattacaaggtcttggaagaaaatcaaccagtaaatccctctaattgagaatttacacacacaagtctattgcagatgtatccacagactagaggtgagaggacctcagaatctcttacttggctgattggtgaaggtttgttcctatacaaaccctgttttttacagagtgagagaggaagctattttttgaaatgcacagaccacaacaaaaggtaacaaggcgcattaagaaaaaggaaaatatagaccaatccaaggaacaaaataagtctccagaaaccaacttaatgaaatggagagattaaattacctgacgagaattcaaaataatcatcataaagatgttcaataaactcaggagaaaaatggatgaacaaagtgagaatttcaacaaagaaatagaaaatattaaaaatggaatcaaatagaaatctcagacctgaagaataaaataactgaagtgaaaaaatcactacctagttttaatagcaaacatgattaagctgaagaaagaatcagggaacttgaagacaggtcatttgaaattgcccagggagcaaaataaaataaaacaaaataaacagtgaagaaagtctaagggacttaggaaacaacatcaagtttgcaaatatttgtattatgggagtctcaaaaagagaagaaagagagaacaatgcagaaagcttattcgaagaaataatggccaaaacttcccaaatacggaaaaggaagtagagatccaagttcaagaaggccaacaaactccaactaggaagaactcaaagataaccacaccagaaaaggttataataaaaatgccaaaattcaaaggatgttaaaagcagaaaaagaaaactgattcatcacataaaagggagcctccataacactatgaggagatatctagcagaaacctttcaggacaaaatggagaagggagatatattcaaaatgctgaaagaaaaaataattgccaactgagaatactatagcctgcaaaattgtccttcaataatgaaggaggagcttctgcacaacaacaaaactgtcaacagagtaaatagacagcctacaaaatgggagaaaatatttgcaaactatacatctgacaaaggtccaatagccagtatctataaggaacttaaacaaatttacaagaaaaaaaaaaaacaactttatttaaaaagtgagcaagggacatgaacagacacttttcaaaagaagacatacatgtggccaataagcatattaaaaaagctcagtatcactgatcattagaaaaatgtaaatcgcttcatttcattcatttcatcttccatcactaatatcctttcctccagttgatcgcatcggctcctgaggcttctgcattcttcacgtagttctcgagccttggctttcagctccatgagctcctttaagcacttctctgtattggttactctagttatacattcgtctaaatttttttcaaagtttttaacttctttgcctttggtttgaatttcctcctgtagctcggagtagtttgatcgtctgaagccttcttctctcaactcgtcaaagtcattctccgtccagctttgttccattgctggtgaggaactgcattcctttggaggaggagaggtgctctgctttttagagtttccagtttttctgctctgtttttcccccatcttcgtggttttatctacttttggtctttgatgatggtgatgtacagatgggtttttggtgtggatgtcctttctgtttgttagttttccttctaacagacaggaccctcagctagaggtctgttggagtttgctagaggtccactccagaccctgtttgcctgcgtatccacagcggcagctgcagaacagcagattttcgtgaactgcgaatgctgctgtctgatcattcctctggaagctttgtctcagaggagtacccggccgtgtgaggtgtcagtctgcccctactgggggatgcctcccagttaggctgctcgggggtcagggtcagggacccacttgaggaggcagtctacccattctcagatatccagctgtgtgctgggagaaccactgctctcttcaaagctgtcagacagggacatttaagtctgcagaggttactgctgtctttttgtttgtctgtgccctgcccccagaggtggagtctacagaggcaagcaggcctccttgagctgtggtgggctccacccagttcgagtttcccagatgctttgtttacctaagcaagcctgggcgatggtgggcgcctatcccccagcctcgctgccgccttgcagtttgatctcagactgctttgctagcaatcagcgagactccatgggtgtaggaccctccgagccatgtgagggatataatctcctggtgtgccgttttttaagcccgtcggaaaagtgcagtattagggtgggagtgacctgattttccaggtgccatctgtcaaccctttctttgactaggaaagggaactccctgatcccttgagcttcccgagtgaggcaatgcttcaccctgcttctgctcacacacggtgcactgcacccactgtcctgcgcccactgtctggcactccctagtgagatgaacccggtacctcagatgaaatgcagaaatcacccgtcttctgcatcgctcacgctgggagctgtagaccggagctgttcctattcagccatcttgggtaaaatacctaggaacccagcttacaagggacgcgaaggacctcttcaaggagaactacaaaccactgctcagtgaaataaaagaggatacaaagaaatggaagaacattccatgctcatgggtaggaagaatcaatatcatgaaaatggccatactgcccaaggtaatttacagattcaatgccatccccatcaagctaccaatgactttcttcacagaattggaaaaaactactttaaagttcatatggaaccaaaaaagagccctcattgccaagtcaatcctaagccaaagaacaaagctggaggcatcacgctacctgacttcaaactatactacaaggctacagtaaccaaaacagcatggtactggtaccaaaacacagatatagatcaatggaacagaacagagccctcagaaataatgctgcgtatctacaactatctgatctttgaaaaacctgagaaaaacaagcaatggggaaaggattccttatttaataaatggtgctgggaaaactggctagccatatgtagaaagctgaaactggatcccttccttacaccttatacaaaaatcaattcaagatggattaaagacttaaacattagacctaaaaccataaaaaccctagaagaaaacctaggcattaccattcaggacataggcatgggaaaggacttcatgtctaaaacaccaaaagcaatggcaacaaaagacaaaattgacaaatgggatctaattaaactaaagagcttctgcacagcaaaagaaactaccatcagcgtgaacaggcaacctacaaaatgggagaaaattttcacaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcagtcattcaaaagtcaggaaacaacaggtgctggagaggatgtggagaaattggaacacttctacactgttggtgggactgtaaactagttcaaccattgtggaagtcaatgtggcaattcctcagggatctagaactagaaataccatttgacccagccatcccattactgggtatatacccaaaggactataaatcatgctgctataaagacacatgcacacatatgtttactgtggctctgttcacaatagcaaagacttggaaccaacccaaatgtccaataatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaactgaacaatgagaacacatggacacaggaaggggaacattacactctggggactgttgtggggtcgggggagaggggagggatagcatgaggagatatacctaatgctaaatgatgagttaatgggtgcagcacaccagcatggcacatgtatacatatgtaactaacctgcacattgtgaacatataccctaaaacttaaagtataataataataaaataaaataaaataagaaaaatgtaaatcaaaaccacagtgagatacataccagtcagaatggctattactaaaaagtcaaaaaataacagatgctggtgaggttgcagagaaaagggaatgcttgtacactgttggtggtaatgtaaattagttcaaccattgtggaaagcagtttggcaattcctcaaacacctaaagacagaactaccatttgatccagcaatcccattactagatacatacccaaaggaatataaattgttctatcataaacacacatgcatatgtttgttgcagcactatttacaatagcagacatggaaccagcctaaatgcccatcagtggtaggctggataaagaaaatgtggtacatatacaccatggaatacaatgcagccatagaaagaacaaaatcacatcctttgcaagaacatggatggagctagaggccattatccttagcaagctaccacaggaacagaaaaccaaataccacatgttctcacttataagtgggaactaaatgatgagaacacatggacacaaagaggggaacaacagacacttgggctgaccacagggttgaggctgggaggagggagaagaacagaaaaaataactcttgggtaccagtcttgggtacgtgggtgatgaaataatctgtacatctaaccgctgtgacatgagagtacctatataagaaagctgcacgtgtaaccctgaatctaaaattaaaagttagaagaaataaagacctatataagcaaatactgagggagtttattaccactatatcgcctttacaagaaatgctaaaaggagtccttcaagttgaaatgaaaacaccctaggcagcagcagaaattattatgagaccataaagctcactggtaaaggtaaatatacagaaaaatagataatactgtaatattttagtggctgtgtataaatcacctttaattctgatactcaagttaaaaggcaaaagtataaaaaacactataactatatgacaataataaaaagggcaagggaggtgaaagaatagagttttatatccaattgaagttaaagttgttatcagcttaaaatatcaactttatatttgttacaactataagatgttttatgtaagccccacagtaccacaaagaaaatactttttaaaaactaccaaataaatgagaaagaaatcaaagcctatcactatacaaaaatcaacaaaacacaaaggaagacagcaagagaagaaaagatggacagaaaagcctcaagacaaaacaattaacaaaatggtaatagtaagtgcttccctatcagtagttacattacatgtaaataaattaaactcctcaatcaaaatggatatagtagctgaatggataacaaaaacaagatccagctattgttgtctacagaacactagctttagatttaaagacactcacaggctgaaagtgaaagcatggaaaatttattccatccaaatgttaaccgagagagcaaaagtagccatattcatatcagaaaaaatggactttaagtccaaaactgtcacacaaaaaaagaaggacataatctagtgattaaaaagtcaattaaccaggaagatataacaattataaatataaacgcatgcaaattcaaagcacccaaatatgtgtaataatcattgagataactgaagggagaaatagacagtaacacaataatagtagaagatagcatcctactttcaacaatagaacacttagaccaaaaatcaataagaaaacaatacttgaacaacactatagacccaattgacctggccaactgatacagaacattttactcaacagcagcagaatgcacatgcttctcaaactcacacaaaatacattccaggatagattacatgttggatcacaaaataagtctcttttcagaacattgatatcataccaagtatcaattcctaccacagggaatgaaactaaaaatcaatagcagaaggaaaaatgggaaattaacaaatatgtggaaattaaataaaacactcttcaataacaatttgggtacaagaaaaaaatcaaaagagaaatttaaaaataccttgatataagtaaaaacaaaacacctaccaaaacttatggaatgcaacaaaagcagtattatgagggaagtttatagtgataaatgtctacatttttaaaaacagaaagaattaaaataaatagtttaattctacctcagggaaactcaagaaactagaaaaaaaagagcaaactaaactcaaaattagtagaaaggaaacaataaagattagagcaaaaataaatgaaatagaaaatataaaaataagagaaaaaatcaatgaaattggttttttgaaatgattaacatcattggcaaacctttagttactaacaaaaaaggaagaagactcaaataaataaaattggaaatgaaagagaagacattacaactgatcactggaataaagatgatcataatagtctataatgtacaattatacactgataaattggaataacctagaaaaaatggatatatttctaaacacatacaacccccaagacttcatcttgaagaaatagaaaatctgagcaggcttgtaactagtaaggagactgagtcactaaccaaaagccttccaacaaagaaacttccaggaacagatgtctttactggtgacttatatcaaacatttaaagaactaatgccaatccttatcaaactctccaaaaaaacggaatagaagggaactcttccaaactcagtctatgaggtcagcaatagcctgataccaaagccagacaaatatactatgagaagagaaactataggacaatattcttgatgaacatagatacaaaaatcctcaaaaaaatagtgcaaactaaattcaacagcacattaaaaggttatacaccatgactaagtggcattgattcttgggatgcaaggatgtttccacatacaaaaatcagttaatgtaatataccaaaataacataattaaggataaaaatgttatgatcatcccaatagatacagaaaaattgtttgacaaaatgcaatatgatttcatgataaaaacttgcaacaaagtaggaataaaaggaaattacctcaacgtaataaaagccatatatgaaaaaccccacaagtaacctcattcttcatggtaaaaacctgaaaacttgcgtgaggaacaaggcaaggactcccactgtgatcatttctattcaacattgtactggaagtactagccatagcagttaggcaagaaaaaaaaaaagacatccaaattgtaaataaaagagtaaaattatctctgtttggaaatgacatgatcttatatttagaaaaccctaaagatttcacacagaaacatacacacgcaggcacacatgcatgcacacacacaaaaacaactgttagaattaacagttccaggatacaaaatcaacatacaaaaatgagttatgtttcactaaccacaaactatccaaaaagaaaattaagaaaacaatcccatttataatagcataaaaaagaataaaatacatagaaataaactgtcccaagtcagtaagcaacttgtacactgaaaactgcaaaatattcccaaaagaaattaaagaagatacaaataaatggaaagatactccatggtcatagattggaaggttaatattattaaaatgtccatactactcaaagtaatctacagattaaatgcaaacctcatcaaaatcccagtggcattttttaccgaaatagaaaaaacaatcctaaaattcacatggaaccacaaagggccccaaaaatccaaaacaattttgagacaggagaacaaagctggaagcatcctacttcctgatttgaaaatatattacaaagatatagtaattaaagcagtatggtgatgttacaaagatagacacatagaccaatggaacagaatacagagcccagaaataaatctatgcatatgttgtcaactgacctttgacaagggcatcaagaatacccaatgaggaaaagatggtctcttccacaaatggggttgagaaaactgaatattcacatataaaaaattaaaatggacccttatcatacaccatacacaaaaatctatttaaaatggattaaagacttaaaagtaagacctgacactgtaaaatattccaataaaaacataaaggaaaaacttcattacattagtcttggcaatgattcttgaatatgacaccaaaagcacatgccacaaaagcaaaaatagacaagtggtggaattacatcaaattaaaaagcttctgcacattaaaaaaaataaaataaccaactgagggaaaatgcaacctatggaatgggagaaaataccctcatattgtatgtctaataaggagttaatattcaaaatataaaaggaactgctacaactcaatagcaaaaaacaaaaacaaataatccaattagaaagtaaacaaagaacttgaatagtcctttctccaaagacgacatgaccaacaggcatatgaaaagaaattataggtcaatgctcctgatgaatatagatgtttaaaaaagtcactaatcatcaatttttatataaattcatatatataaatataagtaagtgctagtgagaatgtagagaaatttacatacatacaaaagtcactaatctcatatatatacacacaagtgctagtgagaatgtggagaaattagaactcttgtacacagttggtaagaatgtaaaatggtacggctgctatggaaaactatggaggttcctcaaaaaattaaaaatagaactaccatatgattcaacaatttgacttccgggtatacatccaaaaaaactgaaattgggatcttgaagagatacatgcactctcatattcactgcagtattattcacacagccaagatgaggaaacaacctaaatgtccatcaatcggcaaacgggtaaaaaacgtagtatattcatacaataaaacgttattcagccttgaaaagaacagggaaatcctgctatgtgtgacaacatggatcaacattgaggacattatgctaagtgaaataagtcagtcacagaagaacaaatactgcttgattccacttaacatgagatatctgaaacagtcgaactcataaaagcagatagtagatttatgattgccaggagcttggggagggttcaatggatataaattttcaattatgcaagatgaataccctctagagatccagtgtacaacacacacacctataattaacaatactgtactgtatatttaaatttttaagagggtaaatttcatgttatattgttgtatttttttaccacaatttttaaaaagaaaaaaagaaagaacttttaaaatatctttttgtattcttaatctaatgaagaaataatcagacaaatgcaaacactgatatattctataaaacaaatagtctggacttttctaaaaaggacaatatagtgttttttaaaaataggaagaaagaggattattctagcttaaaagaaactaaaaggcataataatgtaatgtaatttataagcctaagctttcattggatctggaatttttaaaaatatacatctataaaagtcacttttaagttattttttagccccaaaataaagaggcttaaaaaaacattaatcattttacaatctctcatgatttctgtaggtcagaaatcagaaaaacctgaagtgggccgggcacagtggctcacgcctgtaatcctagcactttgtgaggctgaggcaggcggatcacctgaggtcaggagtttgaaactagcctggccaacatggcaaaaccccgtctttactaaaaataaaagaattagcctggcatggtggctggtgcctgtaatcccagctactcaggaggctgaggcacaagaatcgcttgaacccaggaggcggaggttgcagtcagccaagatcaggccactgcactccagcctgggtgacagagcaagactccatctcaaaaaaaaaaaaaaaagagagctgaactgggtgatcctggctccaggtttctcatgaggttgcagtcagatggtaactagagctggaaaaccaggtggcagtgactagagcatctgtgagctggtgggcatctcttcatgtagtcccagggcttttccatgtgatctttaccggggggcttatctgggtctcttcccagaacaatcagacagctttaaggctccatcaagtgttgcagcaagtaaggcagaagcagaattgccttggattcagaagtcacagcatcacttttgctgtcacaaaagcctgcccacattcaaacacagaataaataaattatctctctttataggagactgacaacattctggaagaaagagaaattgtggtagtcatttttggaaaatagaatttaccacagacaacaatgaggcagttggggaaatttaaatctggactgtataatagatgatactgaattaataaccagttttcttaggtgtgatgatgagattcagttatataaaaaatgtacttattcttacatgatacatgccaaaagatttaatggcagtgtcttgatatctgcaacttgttttcaaatgattcagcaaaataaaaaataaagagagagaccgggcaccatggctcacgcctgtaatcccagcactttgggaggcagacccagcactttgggagacagaggtcggcagatcacgaggtcaggagttcgagaccagcctggccaatatggtgaaaccccatctctactaaaaatacaaaaaattagccaggtttggtggtgcacacctgcagtcccagctacttgggaggctgaggcagaagaatcgcttgaatccgggtggtggagattgcagtgagccgagatcgcaccactgcactccagcctgggcgacagagtgagaccccatctcaaaaaaagaaacaaagaaaaaataagtgtggtgaactgtaagtaatcagagaataggtaaaggttacacagatgttcactctactaattatttgccttttctatagatttaggatatttttctcaattaaatgaagagaaagtaaaatataagtcagatagcattatttttctgctcacaaccctccaatcttctctcttcggagtagaaggcaggctgcttaccaaggcctgcaagatcctgtgtgattcccaaagcttacctctctgatttcatctccaggcaaaggaaacagcaagtacaaaacccccatgagtgtgcttggggtgttttagaaacagcaagttgtttacaatttcctacttttaattgatgtttcaaatatcttctacttaaacctttgtgtacacttcttagagaattcctattttgacctcaagtccctgcctactcatttctttctttgtagtagaaacttcagccctaaaagaactcagtcaaagccaaatcatttctcactacccccaaaaaggcctacaaatttgggccaggagaggcaatcctggcaaggaaatttttttaaaaaggtcccagttacactcaaattgggagtttcactaaattgatatcccccttaggatgcttaatgctcagcttcaatcttacctccagggcatatgatattgtatcatatctgagatttagattgctgaggcatttcctatcataactcagtaggttcttaagattttactttgcagagtttaatccactggggtttttttgtctggttgcttaggctaatgctgcttggtgttctgagcgacctcacttccctgtggccctagagtgtggggtgacctgttgcagatgttagtaatttcctatcttgggtggaggccctcacagaagctttatttgcatatgagtgtatttgcccctgatgttttggtcttggatgtcagcggaattgtccgtccttctgaaggtcatacaataccgctttccagggaggtattataacacagataattgaataattgggccctctctgttttccaaaaggagtgggtttgccacatcttttcttgcaaactagcaaacctagggttaagtagggcttgttggtaaatgtagcgtgtcaggagctcacagccagatatgagccagtaagcaacgtaggtgtcctgggatgacaaaggaggaacatacacacctcagttgtcttgctgattctactctgtgcttccatgtccccttctgtaaaaatgtcaataacactacaataataatagaggtctctcttatgagaaattggttatttagtagacattataaatcaaggtttcaaaaagtattatcgggccatctcaatgttcattgcagttggcatcagtaaagtgaacatggtcaaggtgatattctctaaccatagtaaaataaagggctgaggcattcatttggtgtaaataggacaaacaccagggaggcttggccaggtgtcttttgtagtaaaattgggattctgagattgctgttttccaacttggcaacagccttaaacatcttggtatcctttaatgttatgattccacttctagggatgtctcctaaggaaagagtgctaaatagagaaaaagtgtaaattgtaatggcgacagaaaatagaaacaacctgaatgtccaactgaagggaaaatgtgtaaataaatcatattcactttatagatgattgtacagacttaaaaatttatgcttatgaataatttggtgataacatgaggtatgagagatatgtataaaaagaatacaaaattatacataaatggcaaagttttaaaacaaaatgtcattaaaataacaaaaagatatggatctttgaatgttgaggattgggcatatttttctttctgctcttccatattttttaatttttctttaatgattttatgtcactttttctaacaagaaggataaagcactgattaaaagtgctaagatgagttcttagcaaagaatgattattcctatctaattatgtattaacatttatatgaatcatactaacattatatgactcattttaagataatatattaagaggttcattaaaatgatactttttgagtatataaggaatctttttcttcacatttcaaaacattaactctttctaaaagtccatagtgtgagaggtaaaacactaataatatgtaaactatcagcaattgtacttctcgccataacaactgtatggattgcagacaagaacaaggaaataaataagaaagtccccttgagaagggagagaagacaaaaggaatctactttgtgccaggcaatgtgctacatgctttcataaatgaccttatttaatcctcacaacaactctatgaggcatatatatgtgtgtgtgtgtgtgtgtgtatatatatatatgataaaataagatatatacacatcttattttaccctagcagcaattctgttagatgaggaaactgaaaattctaatagatgaagaaactgaggttcaaagaagttgcataattggaccaaaggaaaacaactaagaaacaagcccacattctttccactgtcattgtgctttgttgatagactacccctggcccatgctcatagccttagatagcctcatttttaaacagaatttggtcacacttcttagtctggtttcttatcctaagggatgtagtatacacaaacattagaacatgacagaaagaagagaaggaatgctagagcaatagcaatggggaatgaaagctgacaaaagagtaaaccaccaaaacaaaaaaacaaaaacaaaactcaaccctattaaaaagcagcccaggaactcaaaaagcatagctatatagcagtatggaactattttatgacagaatatacaactctatgtcatgctgaggtaatcatcatattcagtactttattttccatatactctgtatgtacacactctgtatacagtatgtatatgtattagggggaatgtaatatataaaaattttttgaacaatgggtattgccactctttcctttaagggttctggcttgatgaagttttgttcattggtttgtcttgctttgctattgtaatacatagaattccagtagaagatctacaaacacaagctgattcttaaactgagaaagcaatatccagagtcagaacttgctttttgcttatctacctaactaaaagctgaagaataaatgaagcagtgactggttattgatacactttgcaacatttcactagaacaacttaaaactggaattgaagcatcaactgaagatttctgtgcaactgtggtttaaattgaatgctgcgctttgtataaacataattttttgtggtttaactttaggctgttctctgcggtcttcccatataatgggaatgcgtcagaagcacagcttcgtttcctgtgtaggctggaaactgttaactgcaaagtttggagacagtctcagagagctcactgccatatgttaaactaaacttgatatgaaaaatcatatcagtttccagtttcccagaacattaaaaagaaaaataaaaaaggagctcaagctttataaatataaaaagcatctgtctgcacaggaaattctactctgttattttgcaaatgatccctacttatatttacaagagaaatcagatctgatgaactatatggaagtaacacattattttgttcaaaattttgaaatatatatttataattctgtacagctggctggactgtgaactaactatcattgtacagagatctcaacagtgctgcccagcatgatcttaaagcatgtatgtttccaagtgaaaggtgatggaatattttgacagcatgctgctaacttaaacatttttgtttaatgtaatttttgtgtctaagtgctcccaaccaccatttccaagacaagaagactcatgagcattcagaaaacatttggcactgtttcattttaattttttacttctccttgactctttgagcctagaaagaattttctctgtagttgctcacccaggtacaagtgtccttgagttaatcttcggtagctcattttagaatccgactgtgactaaagttggattctgtgactgccttcttgcctgcctctccactgtcacctataattttgtcatttcttttgctctgaaccagcttgctatgctaaaagccatcccttcctttcacattttataatcctcataagattaacagccaaaatccatgaccagaactctgaccacgtacagtctacagaggacttcatgctaccttgataataccccgtattttaccagcaaccatctctcagacttgactataaccctctggtgtacctcatcaattcaatgctccagtgtttatccttgatttcattgttttcttgcctcacagaggtacctagagattttttccaacagaatctttctgcctttttcacttaatagcctatctatgccagtattcccaagtaaactccctttaactgtaaagccattaattttttcttctgatttcttcttttctctttcccacctttgtcttgcccagtttttacttattttcattcctctagtaacttaggcctcctcttactctcagttccttttattaccattattttctctaaaatcagattaatatcatatattaataataattagtcatccatcactaagtagtgcccacatttactaacttctctgacttaaaagttgctgtcttatctatgttcttttctttcctagacaacactttggaatagtatcttttctccccctaccttatcacaagaagattaaaatgactcttctagtaacaattacacctaccctctcttatctcgcacactgggaggcacacgccatgggccctccttgatagaggtgaagctaaaccatatccttgtggcaacttataaaaacctcaattgtgtggtttgcctctgcctgttcctgagggcatgcagacataacgaacttctctctcagcctggacctgtgctggaaaagagtttgacgcccactaaaacaggcatttcactgtgaattagaaagcctctggagaagagactttatgtaaatgtgtgttctcagtgtggaattgttcttccatgtttacaattgtttgtgtgtctttttctctgtgccaaatttcaggtgactggagactgattagctggtctgtgctatccttactccactttagccaacacattgcacattcttacctccaaagtggcaaaaaatgcaaatgtgtatcattatgctttattagctttagtaaaaagtttgccatattaaaggttaaaatttttggcaattttttgtactcctcgaatatctaattatttagattaaaataattatataattattctagttacctttcttgaatttaagtcttaaaaaaaaccctgcaagcaaacatttacctatgtaacaaacctgcacatcttgcacatgtaccccagaacttaaaatttaaaaaaaaacctgcaagcaaacctatcccctacatattttctcatacttcatccatacatttaacattataaattcttttaactgtttcttcttaaattactttgcactatgccttcataacattatatgcagatagaaagttgcatattattatgaccaaaggtcatttattatctaacctttcatcttggtgttgatgatggtcagctcattaaattgttcttctcaacctgggagaattaagccctaatgctcttatgaatccattgcacgtgatgagttcacttctctagctttgtacccttgttgtgagaattatgaaaataggcagttgaattattttctccataatgatatagagaaataataatacagagaatgtggaatgttctcaaaaactggttaagaaaggctacattaagaaatatttattaaacttctaatatgagacacccactacactaattgatagaacaaaaaagctttgtaagccataaccctttctcttaaagaatttacattttactttatgagatatgaaataatctgatgaaagatctggaaaataatcaatggaatttgagattgaattatgcagcatcaacttgaaatttgaaagtaaaaaaaactatgtgaacttcatcaataatagaggtcttcaaggagaaggtagatttaagttgaaaccttaatttagatttaaatgaaaattgaaaatagacaatgaattatctatgaattgtgaggaagtgaggaggcattcaggacaaggaagaggaaagccataagacagtaataagcaaatcaggtgatagaaccaagagtcacaagcaaatcatttaaataatccaaatatcaaatttcttaactattaaaaaaatagggaaaatgtcagtctcacagggttgtggcaaagaacaagtttgtgaagataatgtatgtgaaggtactgggaaatatagagacagtaagggctcctggtaaataggataggattcttaggataaagacagcttaggaaggtttttgccatttgcctctttctcattaaaatggcatgcagattattcagcatcctctatgctgtacagcatgaattatttctagaagattaatcaccaaatcaaatgcaaaagcatccttctaccaagttttttcttgtctttgatgaaatcactgggttcactgcttttatcagttttcatttggataatatttaaaatgctcttttatcccaatttgaataccctcaatcaatgtcagcctcttttaatttggtttaagattacaggaaaacatcatgaccctatagatttttccaccacaactattaagaacaatggagccagacatattttaacaacaaaagaacatgaatggagtttgccttttgacttatcatttaagtcctgggtttcagatcatgataaatatttcagaatggggtaatcctggatcatgattataaagtatatcaaggctgcaacacaagtgctgctgggattttttaaagggaaacattcttatgagtcttgaagtctcaatgaagaatggaagatttgaatgagttttcctggatgatcatgattcggttaggtgaaggagtggagaaggcaacaatctgcaggaagaataatcctggaatgtttagaaaatccaggaggggctttactgaaatggaaatctaatactggagaacaatgagaaataaagttggatagttacagttaagttgaatgagtaactaattcagtcaccacacacaccctattttaatttcttaagcatattctgagggtctcaaggacccacaggaaaaaaaaaagcataagtccttttaaaaattgtattatatctacgacatccatataacaaggctgaaattagaatctggatgtgttattttaatatttttaattgtgataaaatacacataatgtaaaatttatcatcttaattatttttaagtacagaactcagtagtgtcaagcacattcacattgttgtgacacaggtctccaaaacattttcatattgcaaatctgcatctctatatccatcaaacagcaattccgtattcctcctgccccgaatccttagcaactactattctgttttatgtctctataaacttgactattccaggtacctcacttaagtggaaccaaacagtatttttcttattgttactggcttatttcacttagcataatatcctcaaggttcattgatgttatcgcatgtgtcagaattttcttcctttttaagactgagtaatattccattgtatgtatatatcacatttggtgtattcattcattcattgatgaacacttaaattgcttccaccttgtggccattgtgaataaaagctgcagtgaacatgggtgtacaaacatctcttcaagaccctgttttcagttgttttaggtatatacccagaagcagaattgctggatcatatggtaattctatcttcaattttttgaagaatcattatactgttttccatagcagctataccactatacattcccaccatcagtgcacagggattccaactttctcacaaccttgccaacacattatttcctgttgctttgatactagctatcctaataagtttgagattattttagtattgccaaatattgtgatttatcctacttgcaagctaaaagttggccagctacaattcatggatgctggaagaaggcatgaggttaaatataaaggacagcaatagcaatagccagaatatcagatatattacctaagaggaactccaactttagagaacccaaatctcacataataggcaataaacctgtctgacttttgccctagaaagtcataatttttattatggtggacaatagacaaacctgacctttgccctggggggagacactatttctgtcttccaaggctgtttactttacaaatatctttaaaaagatagtccagggaaaaaaaggcagtcagtatatttgcttgtaagatttacctaaatgagagacccattgaaagcgtgccataatgagtaacttcacatatttttaacattagtactgcataagaaaacatttattcctataaatcagatatgaatagtaatctataaattgaggtttgcaaaaattaggtttttttaattaaattagatcataatgcaagccctcattctgccataattactagaaatctaacttcagttatctgatcaatggtgagaatttggaagtggtaagggagggaaggtggaggtccactcccaattaaacttttttaaaaactagaaaagttttagtgtctggaaaatgaagtaatatcctgtagccttaaacctattattgtgtttaatatatatgtatccttggcttaaatgagcaagactaataaaatccagaaacagcctcattatttttcctgtgcccatccctataagccaatctgtagggctagttcctcccatctccccagaaaaaaaactcaagtaagcctcaacattttttggttattctcagatactaaaaagttctccagtcactttagttgtgaataagtctcaatttagtaagtaatgtatccaatattatataataatcaaagtactaaatgtaatttaaggttgaaacttttaacccctgccctcatcctacagctctactttactacaaggaaggctcttcaatgggaaaatgaggatgatagactttgtctctatttcctaccttacgcctccagttaacatggttcttaacacatctagggtgaaaatagagggggagtggaggaagaggagaggtaagagccaaagacaaagaaatagggtttgtttgtttttttaacctttattttagattcaggggatatatgtacaagtttgttaactgagtgtatttcctgatgctgaagtttggggttcaaatgatcccatcaaccaggtactgagaataggacccaacagctagtttttcaactcttgcctctctcccttcctcccctctctggcagtccccagtgtctactgctgccatctttatgaccatgagtatccaacgtttagcttccacttataagtgagaatatgtggtatttggttttttgttcctgcattaattcacgtaggataatagcctccagctgcatctatgttgctgcaaaggatatgatttcattgctttccatggctgtgtaatattctgtggtgtccctctttgagtggtacaaagaagtacacagatcaacttaggagacaattcagtagcctgttcaaaataacccactaaatgccaggaagtaacagtttggagacaaatttggttagataggtgacttttcaatttagctttggtttaatcttgagtcttctcagagcctagataaaagcctaagaagaaagcaccacaggattgggtcatgtagtgcatctacagtgtacctagttgtacagacattttctagaggctggtgggtgacctaaggtcaagtagcccatttcttgaccagcttatacttttacagtcatcttatttttcagtgatgaacactctaatatctcctaagtgccctcacctaaccacacaggaaaaagaggaaagaaacgaaatacctgtgaattccaacagccagagtttgtgtcccctgcagtaataaccatttactgtaaccactgtcagttacctttaaaactacagctcttgccaatgactcatcaggcaaagtgccacctcatagcacaaactaatccttggtacccaaaatgccaaagaaatcagatatctcaatgtaaaggagagcaaagcttcagacttgaggggaacctactcacgattctcagggctccatgaggaagacagagtactccaaaaaagaaatcagtggcaccttccctgtgttgttcctcaaagggtatcagagtcaccagaagtctcctttaggtctcttcaggtagccacgagaactctattccctcttagtaatttcccatctcctgaccaccaaatgaaggaggtaggggctagaagagaaacgtatcaagaatgcaaggaaactggatggaagataaacgatggttaaaaggaagaaggaggagcaggaaatggaaagaacagatctgagaggagccagtttgagatcttgttttccaaaaaggccagggaagttccacattatcttcagcaaaaataatgccgacaagaaaggaagcaaacagaagggctgagcatttagttagcatgagtttgagaagcttcaattaactgagaagctcccatgggagaagcaagatccaatacagagaccagagaggccttaaataaattataccctgaatatcaacttccaattaagctcacttctgaccatagagctcttttaaatatcttttcaaaaattatcagatttcggctgggacaaacagcaaatattcttggctctattttctcccattaagccaacaatattgaactaatcttatttaccagagattcacctaagtcacatgaaagtgaaaaacatttgggtttgttactatattttcagcagttttaggtatatttagttaatatgagtgtccatttatctataaggcaatttgaaactcatttaagggattcaacaaataaaataaaccaaaattttaaaccaaaggtatacctaataggtgactcaggacaaaaattaataagccttttatgatttaaccaaggattcacaagtcatctctgcagaggtgcaaaaatgcagccctctcaaggtccagagccacttcccaaagacagccaaaagagaaaaagattcagacaatgctttgagagctggcaatagtaggtatgctagctacacatggggttcaagccacatttttgtctggccatattttgggggccagaccacttttcagttggttcatcatggaagcaggcccaataaaatgcatgccctgacaggcaggaagccaagccaagttctcgggacacgaattgaaacaaacaggaaaacaaaagctgttcatgggagggaaggattagtaacaaattggtaccccaagaccaaaaggcacaattcaaacatttttcgtatagtgactcaaaccaataatactatggaaagttcaattccagagactaagacagcaaagacttccattgccacaggtagtaatgacagtatttatgtaaatggtatctccagtctcccacaaaaaatctgggatgcctccagtcacaaatacagtaatctgtgacaacaggcaaatgatactgggatgggagtttccctttactaaccaagcaatgaggacaaggacttcttataagacaaactcccctgagaattgaaatgatcaaaggaaacctctgggttctaggccattcagctggctgcctgacacaagccaacactttgcactttcctaaaatggaacagagagaatgtcttcaatggtcacaaagccaagatctcaggatataaaacaaaagagaatctcaggatataagacaaaaggagaatctcatccagtttttgactcagttacctacagcaaagttagtttaactaaacagaagtctggtaagaactacaaatccaccagcctgtcaggccagtttgagcaacaaccttagaaagcctatgcctgtgctccttgccctgtgattctgctgtttatgataaacaatacaaaagacagacaacagaaaacaaggcagcatctctgcaagggaagggatcagaaaataagactactcataccaaacaaacaaacaaacaatcaccagattcactatacccagcaactcgtacatacggatgattttctcctgctaacctgaattttggaaagaagagatgagaaaattttaccttccattctccaccagacgacactacaggcagagatccaggagggctgtccttggaaaacaatgtttaccatttctttgctggcttttcatctgttgttccagaatctcatctgcaggctctggagcaagtcaagtgtcccagctgccccacattgggcaccagaactataggaataattgactaaatcactgggcacatgattgagctcggtttccagcccttctcttctttctcatccttctgaggattcaaggatactggtgatatcatttgattcaaagctccaccagtctaatcaaatggtcggtctttctggcagggcctatccccatcccaaatcatttcattagtataagctatctagggccccaccatgaatcatctcactagtataagctatctggacccaccatgaataacaaagaactcctatcatttgggaaatttcagagaactagttttcctctcaagaactagagacaaacactaatcaaattctccattacacaacaatcttcaagtggatgaatgaccaaaggttttttaccacctcccttgcaagacaagtggttcaggatctcactctggaatttaggataattgctattgtcttctggcctcggatgaaaactcagtctaaaacatatttacatatgttgcatatttacatcctcttaatcgtaaattggctaagcctgcatgactgcagaagggccagcagatctgtggcttctatgtgcgtcaggctgggaaaagggcaccttgactaagtttggaaacccagaaatcttggctgtagcctgcacagatgtaccacggggcactcactcaaatgcaaagtcctaccacttactcacggtgctagaagggtggctcaggccacccctcactcacagaactcctgttccaattttagttttacagagtctcacttctctctcctcttcttacctagcaaaataatgtcaaaaaactagatgtaaggagaatgaagttgacaaaacagtttaaagaatcatttcattgcacatggcactgaagaacaaaatgaaatcatttctttaaaaagtattcatcctctgccatggttaatcttacgtgtcagtttggtaaggccatggtactcagatatttgttcaaatattattctaggtgtttctgtgcaggtatttctttagatgagataacatttaaatcagtagcctatgagtaaagcagattaccctccataatgtgggtgggcctcatccaaatacttaaaagccttaatagaaaaagactgacctccccagaagaggaaattctcccagcagattgtgcttggactcaaactgcaactcttctctgtgtctccagccctgcaaatctggggcttaccaagtctctatagtcacaagccaattcctcaaaataaatctctgtctgtctgtctctcattttctctctgtctccctttgtctctctctctctctctacacacacacacacacacacacacacacacacacacacacatattctctgtctctgttggttctgtttctctagagaaccctaagacatttttaatattgtataacaatatgcaatattaagtatacataatttattagtagaaatgtgctttcattctatgcatcaaaggaatactctgtactatgtacttacttgctgtaagcatgtttgtggtctgcattttcacatgtgccctctgactatgaaagctgcataattacaaactatctccaggcctttccattttccatgaagtggctttttctttattacttaccttttatttctgcattcctactcaactggcaaataaattgaggcacaaatgaataagactttctactttaatttaaggataataaatatgagtcactaaatttttgtacaacatatcctattagtttcttatatttcgttaagagacaccaatgctaaagagacatgtaacagggaatagctgtttaataacatcaaagaatgttaaaatataattgaaatgatgggtacatatgctactgtacattttttaaatgtatattgaatttcaaagaaatatttgatatatgttaccattaattatttaatatggaagaaagcattttacttcatgctgtgtgtatatacaaactaaacacatttttaattgtctatgcatttaaattatttatgaacataagggaagcttaccaaatttagttcactttaacaggaaatcaaatgcactggtgtaataaaatttgtgatgataaatgcttgtaaattaaagccaataagtataagataaagtggtatctaataatatgtatattatacatttattataaattatatatattaattttataacatacatatgatatatgtagatatcattaaaagaaaaaccttagacaaattaaatttaacagtttaattgagcaaagaacaatttgcaaatcaggcagcctcttgagccagggtacattcagagagattccagtgcagccacatggttgaagatttatggacagaaaaaggaaagtgatgtacagaacatggaagtggggtacagaaacagccagattggttggttacagttcagcatttgcctaatttggacatggcttgaatagttggctacctttcattggccaaaactcagtgattgacacaagaatgggtttatttatttacatctccatttacattatagttcactatgtatagagaaccctttaggctgcacttaaagtatgtaaggaggcatatgctttatgctaaacttaacaatttcccctctaaaattaagaggatgaccaaaactttagtcattgatgtcactattaccatcataattttacttatttggtcttgaaacccagtgggaaaacagtgggttttataaagtagaaacaagcacttcaggttattttttgggtaacggtcagaggagagggtacctccttgttttggaatcttctgcttacaggagaaaaacaaaatctggtctgttttaggacctatctacttccttaaagtttcagtttgattgtgtcatatttagcatgagtgactccattttagtttggtctggtctgctggggcctactgtacaaactcagtctaaaacaatggctcccataattttctttaaaaaaattcctccattttgattaacttctctgtattagtcagagttctctagagggacagaactaataagatagatgcatataaaaagggaagtttattaagcagtattaatgcacacgatcacaaggtctcacaataggccgtctgcaagccaaggagcaaggaagccagtttgagtcccaaagctgaaggacttggagtctaatgttcgaggacaggaggcgtccagcacagaaaaaaatgtaggctgagaggctaagccagtctgatctctccacgttgttctgcctgcttttattctgatcacattggcagctgattagattgtgcccactcagattaaagtgggtctgcctttcccagcccactgacttaaatgttaatctcctttggcaacaccttcacagacacacccaggatcaatactttgcatccttcaatccagtcaagttgacactcagtattaaccatcacattctcacttaggtaacggtgtgacaaaacttagggccttagtgccacttcagttaccatcattttgggtttctagtttcagcacatcattcataagtcatcatgtcctcatggtcacacatttctttaagcttttgtcattacagttcaggagagaccatttgacattcttgagatggctgcatgcaaacattcaaaactttttaaagaaaacagcacatgagggagactactattatgaccatgaggaggataataccaagagtttggagtatgctttttagccagagtccccatgaaccaatccaactacaattaaatagatcaaagaattagctagacaaagagtctactcatttcaaccaggtagcctgttcattaatcccctagaaatgaatctctataatacccaatgtattccttcacgtacaactagaagtaccagcaactatacagatacttctgtttagccagcaagtaatctagagcaattcaattatttagcataactttcacaagagaattttaagtctgttgtgtagccagagcttttgcagtagaatctgctacagagcctatcatgagggataaatttctaatcattgcctcatctactcccaaccacagaaagagcgatctaacaaatgatatccatccaaaagagagaagatctcctgtaaaggttttctttaatccatgatgtaccttaagaggagtggaccaatgttctgtttttgattgactatgaaggaacaaggctaacatttgttgttcgtattggtccttcatctttcatctctcaaggcataaggttgtccatgtggaagtttggctgcgaaatcttccacaaataaaagtataccccaagagggcacataagagaccccctttttagctctattgttgttagagacataagcaagaaaaaatgagagattaagagtttcataacagcagacaattcttgatccatgatcttgggaaaaagccatccacatcaatgatgccatcttcttggggagaaacctccctggttagctttaccttaagagttccaatgggcatacatttccaagactgtggaatgacccttctcagttgtgagattatgaagccaagactcaagttcccaaagttttgctgcagtgtggatggcaagagcaatctttctctgatgttgctcccagaagacccagtcttcatattctagattattaaggggttgattgtcctcagtcagtggaccataaaaagctttctttaactggtgaaaatacactttggcctaatgagctactgttacaacatcagccctcttgcctaggaaagcttttatacaaccagaaaacatacattgaaaatgaaaattgaatgaaatccctctataaatgtttaaatggcccatcaggtaacagaaatgtacctgaagtttagattatcttcctaggaatatgggtttaacaaaccaaacattgatcataaactattttagcaatttaggacagttacaccacctataaatatcattaatatatgatatatttattatatattattaatatataatatattaataatttatatattaatttggattcctttatcatttccatgatgaatcatggattgtacagcttttaataatgaaaactttaaagactcagaaaagacaaagcagccatctaagttctccctgagtccacatttaacattggacttatgtcctcttaaatccagttgtttctccgatttaggtgcagagcactgataactaataggctatcgcagataatttgacttgcaccatggagtttattcaaattgcatatctaaacagtagtggctgatttagcatgaaaatctgagaaagtattttcttgatattcaattaatttttgtcttgcttgggttagcagttttaaaaaccagtcagtttctcattagatttctgggaattcttatccaggcttcataatatgatccaaaagttatcacaaacctatatccaagagtgcttaccagggtgctttgaatcctttcatgaacctccttaaaaacacagtaccctaagattctatgtgcttgtgaagttttcaaaaactgcatcagaattaagcaattaactgtagaaatgactttaaatggtcatagttaaagacaattgacaaggaaatttggttatttctttgacctataaaataacttcacataataaccataactgtgtagcatatactgagatatattagaattttagaaatctgatataattttagaacatatattaataatatattcattaaaatataacttttttttgagataagtctcactctgttacccagactagagtgcagtgccacaatcttggctcactgcaacctctgcatcccaggctcaagtgaccctcccaccccagcttcccaagtagctgggaccacaggtacacgccagcatgcctggctaagtttttgtatttttagtagagatggggtttgcccatgttgcccaggctggtcttgaactcctgagctcaggtgctctgcctgtctcagcctctcaaagtgctgggattacaggcatgagccacagcatccagccaataacttgaagaaagttaaacatttcttatttgtcactgcttcccatgtaattcaacatgtcaaataatcctatttatgtcttttttggatgtttcaggagccctctgtagcatcccaaaattgaaggtcaaaaaacacaatactgaagctgaaatttgatttggggaagcctgtcaaatatgtcaaaggtttaaaatacttaacacaaatatgattataagtaaccataaaataatagtcatttttttagccaatgtaataattaaaagattttttaaaaccaaaacctttactctttgatagaggagactcagttttccaaccaaacgacctaagaaagatagcctgagacagaatgtctctcctctcttctattttttatagtttactcaaaggcgaacaaagatattttactgtcatttattaatactccattgaaattttcctcaaaagagaaaaccaaattttatttttagattactgtattatcaatgctaaagctaattgtaataaaacttataactaaatctatgaaatttgtcatctttcgaccacacaagatttccataggtcttttatgttttacatttttccccaacttcctaggtttatgtaattttgcctattttttagtccttcaatttgaaatgtttaaataacttcaaactagataaaaaaaattttaaatacacattttatgtctttattagtttcctcatcaaaagcatatcttgcttttgtttatacattctgtatacagaattgtttcatatctagtagtagtaatataattatatataaactctaatttaactattagaaccctaatttatagtgaaaactctgaaagtaattttgaactgttttatatcagtatttacaaataaaaaccattttataatttttttcaaaagatggttcaagttattgttttttaacagacctaaatatatttagcttttctgtacaatataaaaaaagtcaaggtatatagaattaaactcatgtttaataagtaatatttcagtttttaacttacaaatgattcagatattttatgtctatgtgttaattaatttagcatagtatgtaagatttgaaatgactgaaataaattttgaaactatgacacaggtaccttccctaatgtcttccccagtcatcttgggtcccaagtagccatgtggcatccaggaggactatgaagggtagggcctgtctgagtcctgaatttgcataccaggtatagaggtcaggacagaagacagagctgtgaagactatacctggagaatctaaccactcccgaagtaaccaggaggcaaagctggggcagggaagaaagggccatattgggtttgactttgctgcatagttgctggtctaggcactgaaaacatgtctccagacctcaccatggccacctatgcagacccccaaacccagaggctctgaaccaaaacataagctccacagtcaaatcaagcaagtatcaaattatattcaattgtattttgaagtcattcctattttaccaagaattttaaaacaagttttatttatcaaatattatcacatacgcataatacatatagacctacaaacacacagacagaagcagattttatacctttcttaaaggattctcatttgccagtttttaaagagtttttcttttccccattcagcctatcaatcttccaattacctattttgtcaccctaagccattgttaactaggcaacaaatttgcatttctaaagggaaaactcttaggtgaagcaagaaaatttctatttcaaaagcacagagctaacactttaggcctaaatacagtaccatttgctcaaaccaaggggaaagtggtgtaagtaaaagttaagttagataagacggccagaaaagcaccttaaacagatatatgacttgtgcaaattaaaacaatgggaagagtttctaatgtacataggcagacatcttacaaatggagatttcctttataggtgtgaatttcttttacaaaagggtttcaggaaagccagttaaattccagaaaggtgtattccagtttgataggtggtgatcttttaaacttagctattgtttcttagctaaaattactgagttcaggatggagtccattaaggaatagagcaaagaaagcattctctaggcctggactcagcatggatgggtctgaaaaagcaaggctacttttcccaagggcctacttaatttttgtgggtatatagtaggtgtatatggggtacatgagatgtattgaaacaggaatgcaatgtgtaataattacataatggaaaatgggaattgcatcccctcaagcatttgtgtaaaaaacaattcaattatgctcttttagtaatttaaaaacatacaattaaaatattattgactattgtcaccttgctgtactatcaaatactagtttgatagtaggattgctgaatcatacggtaagcctattttaagttttctgaggaatctccaaactgttctccacagtagttgtactaatttacattcccaccaataatgtatgagggttctcttttctccaattcctcaccagcatttattattgactgtcttttggatataagccattttaactagggtcagataatatctcactgtagttttgatttgcacttctctgatgatcaatgatgttgagcactttttcatatgcctatttgctgtttctataccttcctttgagaaatgtcttttcaaatcctttgcacattttttatcaaattattatattttttcctacagtgctgtttgagctacttatacattccgcttattaatcccttgtcagatggggagtttacaaatattttctcccattctgtgggtagtctcttcactttgttgattgtttccttcactgtgcagaagctttttagcttaatgtgatcccatttgtctatttttggttggttgcctgtgcttgtggggtattactcaagaaattttgcccagatcaatgtcttagagagttccccaatgttttcttgtagtagtttcacagtttgaggtctcaggtttaagtctttaatccattttgatttgatttttttatgtggcgagagataggcatctagtttcattcttctgcatatggatatccagtttttccagcactatttattgaagagattgtcttttccccagtgtatgttcttgacacctttgtcaaaaatgagtttactgtaggtgtatgaatttgtttctgggttctctattctgtttcattgatgtatttgtctgttttaatgccaacaacatgctgttttggttactacagatctgtagtataatttgttttttgtgggtttttttttttgtttttattgtttccactttattgctctagcatggaacttcaggcaagcctggaccttcatcaacatgcaaagaagaggctgagggggtttggggacacaacctggctgagagggaaaactgacaggggaaataccagaacgggggacagggggtggtcaccatgacaccaggagacagcatcagccatgccatctggggtgaggaagggaacagagaagaaatggtgtttcttcccatgtccctaacacccacatggaggccacatttggaaatggactgggagagggaaaggatgaggaaaacagctgcccaggagtctccttctccaccctgggttcatatcagaccccatccctaccacttgcctcttctacccctggaaaatggacctaacaaacagaaggagcaaaataaattaacactctaatgagcatgtatggatggacatatgttcatgtgcaatgggggaagggaagagggggtgacaccacctaaaatgattccccacctcaatctcccagcctactcctttcccccttccccctaaagccaccatccaaccagatagaaaaataaaggtctaattcactcaaaattcttcagtttttacaaaactaacagggcagagtagggagacggggggcaggcagccacaggagtagggctggtggagaggggctatgcttctgtctccacttgagactggctctctgtggtgttgctcttctgctcctccatctctgtgtcagtgagattgtctcctgaggaagcctctgccttggccttgttctcttcctcagccagcctctcaaacgtgttggcgtagagcgtcttctcccaggcaagctgcctgcagatctgctgctggcacacagccagctgggccttggcggcttcgttgttggggtagagctgcaagaccttctggaagtcagcctgtgccagttcaaagtcattcacagccaggtgggcctctccccaatggaagaggcccttctcgttgttgctgcccagttccagggccttgttacagctttcagtggcagcagagaaggcctgtagtttcagatgacacatggccaggttgaggtaagaggccagttgaagggcctgtgccttctgtgtttcctcattggaaaaactagactcatattctacccaggacacaatcctcttatattatagtaaagcttgcttgtatttgccttccttgaagtacacagtgtcccactctttcactgtggtgctctgctccagcttctcttctgaattcatctcccaagactccttggtcttttcaaaactcttgaggtgtaattcatatttcagctaggcatttggtgggatttggaacttttccttcctaacactgccaaaagcatagctgggtttgaggtacacaatggaatgttctcctttctacatgcactgaatggccctctccagaccataaggcagatccagattctcctgatgttcaaagaactagtccttgtagcacccttccagtgcaatctccatgatagcaccctcattgggcctgggatagccttcaccgcaagtctgtaattctgtagatgattccgccatcttcttcttccgtcagatcttctcccttaaactcaaacaactccacctcaaacacgagtgtggcattggggagatctttggaggactgcctgctgcaccgaaggcatattctggtttgcaggtgatatggcacacctcccctgccttcatggctgctatggcaatgtcccaagccttgttgacctccccttttcccaggtcaaaggagaatttgtccttgtgatccagactggggtcaaagtttgtgccatctaacagccagccagtgtagtggacaaagattcagtccccaatcatgggcatctctgtacctgtgccctctctcgatgaccttcagcatgccttcctcctgtttgggcgaatgtccactccctccatgggaagaggcgccaactgtgtcccattctcagtctccttcatctcctcaactgtcatctccacgcagcgcaccctttctgggagctggcaccggcaccagcatactctgagccaaaggcaggggtgctaccttcagggtgtgcaggaggccaggtgctgtggtgctgactgcggaccacatggaggctggagcacctctgccagtctgtagtatgatttgaagtcaggtaatgtgattctctccagttttgttctttttgctcaggatagctttgactattctggatcttttgttgtaccatgtaaattttaggatagttttttattattaatatttctgtgaagaatgtcattggtattttgaaagggactgcaatgaatatgtagattgctttgggtgatattgacattttaacaaaattgattcttcccatccatgaacatggaatgtatttctcttttttggtgtcctcttcaatctcttttatcagtgttttatagttttcattgtagagatcatttctttggttaaatcctaggtgatatggtttggctgtgtccctacccaaatctcaccttgaattgtaatagtctccacttgtcaagggtggggccaggtggagataattgtataatgggggcagttcccccatactgttctcatggtagtgaataagtctcatgggatctaatagttttataaatgggagttcccctgtacaagctctcttgcctgccaccatgtaagacatgcctttgcttcttctttgccttctgccatgattgtgaggccttcccagccttgtggaactgtatgtccattaaacctttttcctttataatttacccagtctggggtatgactttattagctgcatgagaacagactaatatgctacatatctaattttatttgtggctattataattaggattactttcttgatttctttttcacactgttcactattagcatatacaaatgctactgatttttgtatgttggttttgtatcctgcaactttacaaaatttatcagttctaatagttttttggtggcgtctttgggttttcccaaatataagataccatctgcaaacaaggataacgtgacttcttcctttccagttggatgccctttatttcttcctcttgtctgattgctgtagctaggacttctagtactatgttgaataacagtggtgaaagtgggcatccttgtcatgatccagatgggagagggaaggttttcaggttttccccattcagtatggttttagctatgggtctgtcacatatggttttaattatgttaaggtatgctccttctatacgcagttttttgagggtttttcatgaagggatgttgaattgtatcaaatgcttttttaacatctactgacatgatcatacggatttgtccatcattctactgatatgatgtatcacattgattgatttgtgtatgttggaacatccttgcaagccagagataaatcccacttggtcatgatgaatgaccttttttaccatattagtgaatttggtttgctaataccttgttgaggccttttgcatcaagattcatcagagatactggcctgtagttttctttttttgatgtgtctatgtctggttttggtatcagagtaatactggcttcatagtatgtgctgggaagtagtccctcctcctctattttttcagaattgtttcagtaggattgctattagttattttttaaatgtttagcataattcagtattgaagtcattgggtcctgggcttttatttacagggagatttttaattacaacttcaatcatgttacttgttattggtctgttcaagttttggatttcttcatggttcaatcttggtaggttgtatgcatctaggaatttgcccatttcttctagattttccaattttttggcatacagttgctcacagtagccagaaattatcatatgaatttctgcattatcagttataatatctcctttttcatctctgattttacatatttggatcttctttttttttcttaggcaagctaaaagtttctcaattttctttatctttaaaaaaacttttcgattcattgatcttttgtattgtcttcttcatttcaatttgatttatttctgctctgatctttattattccttttcttctactaattttggatttggtttgctcttgcttttctacttctttgaggtgcatcattaggttgtttatttgaagttttttttttttttaatgtaggcacttatagctataagcttccctattagtactgcttttgctgtattccatacaacaaaatggtatgttgtgtttccattatcattttttccaagaaatttttcaatttccatcttaatttcttcatttacccactggttgttcaggggcatattgtttactttccatgtgtttgtatagttttcaaaattcctcttgttattgatttctagttttattccattgtggtcagagaatgtgcttgatatgattaacatttttttgaatgttttaagacttgttttgtgacctaacatatgatctgtccttcagaataatctatatgctggggaaaagaatgtgtattctgcagtctttgaaggaaatgttctgtaactatctattagatgtttctttgttgattttctgtctagaagattgatgcagtgttgaaagtgggatgttgaaatctccagctattattatattggggtctacttctctctttagctctaataatattttctttatacatctaggtgctccagcattcagtgcatatatatttaaaatcgttatatcctcttgctgaattgaaccccttatcattatatagtgaccttctttgtctattcttacagtttttgtcttgaaatctattttgtctgatatgaatatagctgcttctgctcttttttggtttccatggacttggaatatcttttccatccctttattttccatgtgtgttttataggtgaagtctgtttcttgtgggcaacagatcattgggtctcagtttttggggggttttttggtgtgttttgttttgttttttgtttattttttggcttttggctttttttttttttttgagatggagtctcactctgtcaccaggctggagtacggtggcacgatctcggcttgctgcaacctccgcctcctggattcaagcaattctcctgcctcagcctcctgagtagctgagactacagacacacaccaccacgcccagctaatttttgtatttttagtagagacagggtttcaccatgttggccaggatggtcttgatctcttgaccaagtgatatgcccacctcagcctcccaaagtgctgggattacaggcgtgagccaccacacctggcctcattgtttttttattccttcagctactctgtgtcctttgaagaactgtgtccatttacattcaatttatagataagtaaggacttacccctgccattttgtgatttgttttctggctgttttgtggtcttctcttccttctttctttccttcatgtctttctttttgcgaaggtaattttcattggtgatatgatttagttagttgctttttattttttgtgtctccattgtatgttttttgatttgagggtatcatgaagcttgcaaatactacgttataacccattattttaagctgataataacactgtttgcataaacaaactaacaaaaagaaaatttacaaagacttcctgcattaactttgtgcccctgctttaagtttttgttactatttatatcttattgtaatatgtcttgaaaagttgttgtagttactatgtttgattggtaagtcatttaatctttctccttaaataacagtagtttacacaccacatttacagtgctataatattctgtttttctgcagactattactagtggattttgtaccttcaggtgattatttattgctcattaatgtccttttctttcttattaaagtactccctttagcatttcttgtaaaaaaaaaagtctgatgttgatgaaatccctcaactttttttttgtctaggaaagtctttattttttcttcattcttgaaggatattttcaccagatatactattctagcataaaagttctcttcccttcagcactttaaatatttcattccactctctcttggcctgtaaggtttccactgaaaaggctgccactagatgtgttggagctccattatttgtttcttttctcttgctgctttttggaacctttttttatccttgacctttgcaagttgaattaccagatgccttgagttagtcttctttgcatgaaatctgcttggtgttctgtaaccttcttgtacttggatactgatatctttctctaggtttaggaagctctctgttattatccctttgaataaagtttctatgcatatctctttctctacatactctttaaagccaataactcttagatttgcccttttgaggctattttctagatcctgtaggcatgcttcatggttttttattctttttgcttttgtctcctctgactgtattttcaaatagcctgttttcaagcttgctgattcttttttctgcttgatcaactctgctattgaacgagtctgatgatttcttcagcatgccagctgcatttttcaactccagaatttctgcatgatcctttttaattattttaatctctttgtcaaattcatctgatagaatcctgaatttcttctctgtgttatcttgaatttctttgggtttcctcaaacagctattttgagttctctgtctgaaaggtcacatatccctgtttctccaggcttggtttctggtgccttatttagtttattcattgaagtcatgttttcctggattgtctggatacttgtaggtgttcatttgtgtctggccattgaagagttaggtatttattgtagtctttgcagtctgggctctttatacccattcttcctgggaaggctttccagatattcaaaaggacttgggtgttatgatctaagctatatctgctttagagaggacccccaagaccagtaacactatgattcttgcagactcatagaggtactgccttgatagtcttggacaagatccagaagaattatctggattaccggagactctggttctcttcctttactttgtcccagtctctctctgtgctgagccacctggagctagaggtggaatgacacaagcacccctgtagccatcacccctagaactgtgctgggtcagacctgaaaccagcagagcactgggtcttgcccaagccctgctgtaaccactctttggctaccagctatgttcattcaaggccctgaagatctgcaattagctggtgacagagccagccaggcctatgttcttcccttgagggtgatgagtttctccaagcccaagctccaggagggtccagaggtgccattcaggagccagaaactagagtcaaaaatcttagaagtctacctggtgttctattgtactgtggctaagctggcactcaaaccacaagacgcagcgcttcccatgcttccctcccctttccaaatgcagcgagcctcacctcatggccacggccacctcaggcccacagggagtactgccagactaccaccatgttccctttaggctcaagggctcttcagtcagcttgtgttgaatgctgcctggcctgggactcaccctttagagcagtgaggtcccttctggcctaaggcaagtccagaaatgccatctaaaaaccaagtcctgaaatcaggtaccgtgagagcctacttggttttctacccagctgtagggcctaccttatataaactttttatccaggatagctttcttttttgtctttgggacagtattgtaactaagcaaaaagataagcggatttaatttttcttattagtcatttaagatttttatttgccttttataaggagtctttaatttaaaatactgaaatactttagaagcttctgcatatcagtaggcatccatagatgagagtaatttggaaagcttcattttcttttctttttttttaatttcaacttttattttaaatacagggtacatgtacagatttgttacataggaatattgtatgatgctgaagtttggagtacaggttccctcaccctggtagtaagcataatatagtactcaataggtagtttttcaacccacccactcccaagctcgagtagtccacagtgtctatcgttctaatatttatgtccatgtgttctcaatgcttagctcccaattagaaggaagaacatgcagttttgaattttctgtttctgcattaatttgctgaggattatggcctccagctccatccatgttgctgcaaaggccatgatttcatttttttataactgtgtactattccgtggtgtgtatatacagcattttctttattcaatccaccactgatgggcagctaggttgatcccatgtctttgctagtgtgaatagtgcaacaatgaacagaaaagtgcatgtgtctttttggtagaatgatttattttcttctgggtgtaaacctagtaatggtatggctgagatgaatggtagccctgttttaggttctttgagaaatctccagattgctttccacagtggctaaactaatttaaattcccactaacaatgtataagtgtccacttttctccacatcttcaccagcatctgttgttttttggatttttagtaacagccattctgactggtgtgagattttatctcactgtcagtttgatttgcatttctctgatgattagtgatgctgagcattttttcatgtttgttggtgacttgtatgacgtcttttgagaagtatgtgttcatgtcctttgcccattttttaatgaagttatttggtgttttgcctgttgatttgttcaagctccctatagattctggatactaggccattgttggatgcatagtttgcagatatcgtctctcattctgcaggttgtctgtttgctttgttcatagtttcttttgttgtgcagaagctttttagtttaattagatcctttttgtcttgttgttgttgttgttgcaatggcttttcatacttagctaaaaattttttaccaaggctgactttgagataagtatttcctaggttgtcttccaggatctttacagtttgaggaccttcattgaaatctttaattcattttgagttaatttttgtatatggtgaaaggtaggggtctggtttcattcttctgcatacggctaactagttatctcagcaacatttattgaatgggaagtgctttccccatggcttgtttttctcagccttgttgaagatcagattgtggtaggtgtgcatctttatttctgagttttctattctcttccatttgtctttgtctgtttctgtaccagtactaagttgttttggttactgtagccttatagtagtagtgtagtagtaggagtagtagtgtagccttatatagtgtagccttgaagttgggtaatgtgatacctctggcttcattcttttgcttaggatagctttggctattggggctctttttcagttccatatttattttagaatcatttgttctgtgaaaaatggctttggtagtttgataggaatagtgttgaatctttaacttgctttggacagtatggccatttttacgaaactgattcttccaattcatcggcatggaatgtttccccatttatgtcatctctgatctccttctgcaatgttttgtagttctctttgtagagatctttcacctccttggctacctgtattcctagatatttcattttcttttggctattgtaaatgggattatgttcttgatttcactctcagcctggactttgttggcatatagaaaatgctactgatttttatacaatgattttgtaacctgaaactttactaaaggtgtttatctattctaggagactattggcaaagtctttaggattttctaggtatagaattatgttatcagcaaacagggagagtttgacttcctttcctatttggatgccttttatttctttctcttgcctgattgttccagctatgacttccagtactgtgttgaacatgagtggtaagagtgtgcatcttggttctgttccagttctcaaagggaatgcttcaagctattgtccacttagtatgatgttggctgtgggtttgtcatagatggctcttattattttgaagtatgttccttcattgcctagtctgttgagggtttttaacatgaagggatgttggatttcatcaaaagctttttctgcatctattgagaagataatttcatttttgcttttgattctgcttatgtagtgaatcacatttattcatttgcatatgttgaaccagccttgcattccaggaataaagcttacttgatcatgttttactaacttttcaatatgctgctggatttgattttctagtattttgttgaggattttcaggtctatattcatgagagatattggtctaaagtttcctttattaattgtgtctctgccagatttgggtaccaggctgatgctggcttcatagaatatattagaaaggaacccctcctctttgattttttgaataatttcagtaggattggtatcagttctttgtatgtctggtagaattcagctgtgaatccatctgagccagggctttttttggttagtaggttcttaattactgattcaatttcagaagtcgatagtggtctattcaggttttcaatctcttcctgattcagtcttggaagattgtgtccttccaggaatttacctacttcctctagattttctaatttgtgtgcatagggttgtgagccctcattttcaactgcacttcttcaagtgcagtgttgtttctttggaatgttccattgtaattttaaattacctttagtaagattttgctatttctaaaagtgtttgctgtttccagaacctaatacttacacatgtaagtgtgggcataatcagaagatacattactcagttcttaagaaaataaggatcccatttttatcttgaatcttagctttaattctcagatcctcttaatcaacttagccaataattttttcctacctcagcacacaagaaaaacaaaggaggtagaacacaaaaatccctataaatttccaaaaccaaagtttgcatcccctgaaatattgccattttctactggtttctgtctgaaccattcagacataagaggcctgtaactagatccaagccagttaattatcagattctggacccaattcagtttttttgtgacttccaaacctagtttcgatcagaaatttgctcaaacaaactcagaaagctcaaaacacaaatatgtggagctttgaattctgagagagaacttaccatcatccccagttgctgtgaaagagcaatggacacaatgggccctgcaggtacctcgcttggtcacttgatgctcctgggggtcactgaaagctctaattcggatcccacttctgacaccatctgtttaaaaaaaaaaaaaagccttagacaaattaaacttcacagagtttaactgagcaaagaatgatctgtgaatctggcatctggcagcctccttagccagagtaagctcagagagactccagtgcagccacgtggtggaagatttacggtcacaaaaaggaaagtgacatacagaaaatggaagtgaggtacacaaacagccagattggttacagctcaacatttgccttatttgaacatgttttgaacagttggctgcctctgactggccaaaacttggtgactggcacaagagtaggttactgtctatttaaacttccattgaggttactgttcactatgtacagagaaatctttatgccaaacttaaagtatgtaaggaagcaactttaggataaacttgatttaacaatattacatgtgaatatgtgtatatacacatgtgtctttgtgaatataaatataaatctatctatatatattctctaagatattggcacttctaataaagtggttattaaataatatttaaagataaaaacaatgaatttgattagtttagaaagcagagaaagttaacagagcaattctaacacaaatatagttgcttatcattttcagtgtgaaattagagtcaacaaacccatgattttcttagtattcactcactctatatctgtgtacaagtaattggcttattatattaaagttgctttttacttcattttatgttaactctaaaaaactgttaattgtggagtttttaaatgttgttcaatttcttttcattttaataataatattgttaatgttatcattgcttctattttctatgtgcctaacatttctctagagttgagcaggccttatcttccactttatagtgacagtaaattcatttgtgaatggggaagattttcatttatgcagatgggcttgagatagacaaatagatactcaaagagaacaacagagaaatacacaagaatatacacaatatttatactaatttatcatctatttacagaatgatagacattgccattgagttcatatgctagatacattgagtttatctatttatatatcatttaaaaaacagaatggaaatcttcctatatacagtaaacctttccctgccctctaaatcaggatattccacccataatttgcttatctcattgtgctctaatacattgacactcacagaatataggacagttgtatctacattagatggttccagttagtgatgctaatgttcttgttcagcttttcataggtgtttatttcttcaactttagagacagagttcaagatattagtcatttcttgctgctattctctgccagataagtcaatgtagtacaatgtgagagtctaggctttgcatccagatagacctgagattaaatcctgatcaactctttactagttatatggcttgtctgactgtaaagtggagatgataatatccacctccataaggttcttcttataggtgatgacagtacaaatatacagtactggccacctatcgggctttcttttttttttttttttttgagacggagtctcgctctgtcacccaggctggagtgcagtgccgcgatctcggctcactgcaagctccgcctcccaggttcacacccttctcctgcctcagcctcccgagtagctgggattacagaagcccgccaccacgcccagctaattttttgtatttttagtagagacagggtttcaccgtgttagccaggatggtctcgatctcctgacctcgtgatccgcccacctcggcctcccaaagttgggctttcaatagatatgtgtctcttgccactaccctctacaacacccacaacacccaacacccacccacattcatccccttttcatgctttccttcctgtcatctgtgaactgggcaactacataacgaagaagatttgaattatatctaaaccaaaatccagttattataatagaagtatttatttattctgagtgtacactattaattagcaaaacaaagaacataagcctaaaggctaacctatttggacctttaggtgggtaatatttgagatggtccttgaaagttgataggatttagactgaaagacatatgtagagaagcattctgtacagaggaaactgtttcaggcctaaagcacagcatagaacaaggaatgattcaatttatctggaatatagggtgtatgtggtagaagataaaactcaagaatgaatataggcctgttttgtcaaggattctgagcaccaggttaagaagtttaatttgatggaaaataggagttactgatatttcctaagcaaaggacttttgttttaggaggatttctctgtgttagcatttgggatatattagtgctgggagaaacaaaagtgaggaggtcatttagaaagttattagagtggttcaagcaaaaagtaacaaagactaactctcacacattactagtggtaatgtaagtcagtacaatctctatgacaggcaacttggcaatctctaccaacattacaaacgcacataccattttccttagccattccacttctaagaatttatcctcagatatattttcgaatgagtgaagtgatgcatataccaagttattcataatagcataaaaccttaataagaacttgaataacttacagcacattcacagtaacagaattacagcatatatatatataataagaatggggaagtcccttatgtactgattaaaacaatctctaagatgtattaaatttttaaaaattaatatattaaattgtgtaccatttgcttccatctgtgttttaaaaataaaagaaaattctggaagaatacacacacacacacacacacacacacacacacacacacacacacaaattatatctgtggcttcttgttgaatccaaaataaatattaaaagaaataaggcctaaagtcaaagtggtacctataatattggagagataacttattagaagttgatagtgggggaaaatttataaagaaagaatatggacttagaagaacagaaatttgtagaaagcctagtattgaatagtattatgccatgttatggcatgaagcagatgagtgtagatttgcgtgctttaagcagaaagaaaatttaagaaatcatgtttgcagaatataattgtcatcccaattttgccaaacaggcaccaaaatgcttggagatttattgtttcacccaaagtcacacaagtgatgacacagtaaaaacaaaaaacttctttcaaagttttatctaaagctccaatggcatagatatttagacaagtatagacaattgccttcacagctggaagtgccctcttcctccctcaccagttacccatgtaccttccctaacaaggtgaattttcttattcagcaggaaatattccctagacattagtgtttaatgaaaccatttattaaaatccgtgtaattctttcaaaattctaacatatccgaggcttgcctgattctgataataatattcaagcaaagatttttagaaaattttctttaagtcagtatgaaattttgacatttagtcaagattgaatctatggttcagatttcataacctcattaagtctccttgtgcctcttatgtgcagttctgggtacttactattatgtggaagggttaacatttttagaaaggaaacatttataaaccctagttctttttaacaagctgatttagctagttcctaagataatttactttcagaaagtataaccctttactacataacagtattaacttatagattgatttatctatcaataagttatttaagggagttataatttaaagcaataacaaaaaataatacaccaaatgtgaatctaccactgcaaaatttttaatagatacatggtttagttacagtcttttatgaacttctcaccttttatccccagagttagaaacttctatcagggtattattctcactgcagctgaaacagccctccagatgccagcagctttggcagtaggtgtcctctagtgctgactcataaaggtttgaaattttttatatttctggtctttcccccatctctgcagagatgcctttctaggtattttgcttttaattaagtctttatacagtaccttagctgactcttgtatctgggtcagtcttctcatccctgcaaagccctgggaaaactacttcactgaggttatctttgtgacaaactttacttcttaaaatttcttatttcaatcaaaacagatgtggcttgcataggcccagtcaagccctagtatattctctctaataaaggaacagttcatgggtgactttgttaatacttagcaagtgttcattctttagcattgttctttttgtcctttgagtctttactctctacttaaagaactgggtttctgaaccaaattagtactctcaaaatttgtcaacacttcacaaaccccttcattagaggggctgtcttaaaataaataaattttttaaaactgtaaatgtttgaatatttagaaacttaacaacaattaatcactagctttttcaaacccagcatttttaaatcacaaaataaatatatttgtttggtattttgataaccctctccccccagagtgaattcagccttatgagcaaatatagttaattgaaacctcttagtagtgaagctgatctttgtgattacctaaatttaattcattcacatatgagccaaaatcaaattttcatgtaggtcaattttctggaaagtttttgaagttaaacacatttagagatgtttaatttaatgctcttcctatatctattatattgtggagggagtgatttaaaacaaagaagcaaaatgcttcctgctggaaaataaagatgttttcattgcaaaattaatataacctttgtgctatgctgctgcttaaaaaaggatgtctattaattaatcatttttaaatctatcataagaagtaactgtattcattattctgtcactttctaacactaaaggaagaagaacagctgttgtctggcctctaactaactgcaatggggtctttcagaataatacagaaagaacattagaacagcatgagcaagatacacaattcaaaattaatcgaaaattggtgatctgagaactggagatgttctcatgacatgtaaatatttgttcagcagctaaagtaatagcaatgcattaaaccaatagaattacttttgacacctaacagaaatgttaattgatcatcaatctttagctcgtaataaaagggctgaacttgcagttctgaaagtatagccagaaaaattatgtgagagacataaatgttataaaaaagacaaactgctccaagctaaattgctttaaattacattgacctcatcactgtacctttgaaacctgtctctaattgagagcaattgatttacccttccaactttcctttaaagcctatcagatcccaaattctaaatgttaagaaccctttgccaaagtattctgcaattgagctttcctttgagattcttaagtgatgactaaggcacgagccaggtagaaaaacagtactcagtgaatttaaaccttagaaattaaggtgacatcttttgtctccccctggagaaggtgataaagtgaaagaaatttttagcataagaccattgtaattacacaaaaacatgaaagataatagacaccaaaatgagctgtgagagggacaaacatgccaaaatttctaacacctacccacacccagaataaaaatgtcaagttcctggaaattaaggaggatttgtggggaggatttttggaaagagttgtgctgtgtgttgagcatgatcccaccaccctctatccacgggagaacagaggggtcattgcctgctctgctgctcagctgagctctggcttgagggtcactgagaccatcagagagcttaagaggtgtttcctgcaggagggggacacagtaggttgttgtctgccttacaactaataaatccaaagtatgagagagagattggctaaagtggtatcagaagaagaaataaccacatataagaattatgtgcccttttttccaaagacagatcaaaggctcccaaatcccagggcccaaatgtgcaactcttaaaaggaatattagcctaggatccttttaaaagggaccctgctgggccgggcacggtgtttcacacctgtaatctcagcactttgggaggccaaggcaggtggatcacgaggtcaagagattgagaccatcctggccaacatggtgaaaccccgtctctactaaaaatacaaaaattagctgggtgtggtggcacgctcctgtagtcccagctactcagaaggctgaggtaggagaatcacttgaacccgggaggcagaggttgcagtgagcctagattgcaccactgcactccagcctggtgacaaagtgagactccatctcaaaaaaaaaaaaaaaaaaagcggggggaccctgctcaagagggttcctgataaaagactaggggagtcactggctaccaaaggaagttgtactgatggggcccagaagtgatgactccaaagatctcagatgattttaaacatatgcatatgacagtatcagttgagtaataattccctgcatccttttcactccttcatctccatgtcccagatactaagggatcagaaacctcagtaagcaagtagagtaaaatcacccactggagaacagagcattgatcagactttcttcccagcctctcttgcaaattctctcctgcaccaggtctcaggaggatgagaggagcagatttaatattgcaacaagtttggaatttttattgttctttgaaccaaaagatttaaactactaaatcaagacttaaagctacatggcaactttctgtcacctaagagattagggaggccattctgcaagggaaaactacccatactgaacaaattttaaagggacagtgggaaaaagaagtaagattgctttagtaataatatcccatgaatcctaattatttaacatatgagctacataattatttttaagattatttcattcattttatattcagatttttataccatgaatatacatagaaatataaaatttctaagaatgaaataaaaagatttttaaatgtcttgctaatcacagtagcctcacattatgattaacagatgtaaatccatatttcaaatactcttcttcaaacttttgaaatttgggagcctactattgttaaatgtgattatatcatcactgttttcatcgcattaggggctgacaagggttcagactagaaggagcacaggggttggctctggcactttcctttccttcacttgtgctttcattattattaacagcattcactatgaaccatggtttcttataatctttttaaggcgcttggactttttgtgatggttagcctaattaaagctagaaagtacagtccgtaaatctgtgtaactaggctctcataaactgccatgtactataatacactgcaagtaaagtgaacgatgtgcctgtgtcaaggagtccccttgaggaactccttctcttccctcaggcttgcccacatcccagaagagggcttagtgagaaacttcagaaggcaacgactcaaagcccctcacttttatggaccccttccacagcttgtttgggaccactgtttctttccattccactttcccttgtatcaaacatccccttaggacaggtagggttggaatagcagcgggcatctttttggatctaattagaagagggatacagttagttgggttcacaatgcaaataaagcatttggaatttgtatgatgacctgatgaaaaaacatgccacaatgtgcattttattaattgttttttataaataaagcagatagaggcagctacagtctggattaaaagtagagaaaggccaggcctcatgcctgtaatcccatcacttagtgggggcaaggtgggcagagagcttgagcagcccagaagtttgagaccagcctgagcaacatggcgaaaccccatttctacaaaaaaatacaataattagccaggcatggctgtatgcacctgtggtcccagctactggtgaggctaagatggattggtaaattgagcccaggaggctgaggctgcagtgagctgtgatggagacgttgcactccagcctgggtggcaaagcaaggccttgtttttcattcattcttttataaataaataagaaattattatatccaatataatgtttgataatatcatacaacatagcatcaagagtatgctatgaccatttgcagcagaacaatcctacacctttaaagtctacctgatttggacattttttaaaaaaggatgaagggttttctgaatggctgacttattttttctatacatgaggaaagaaccaaatgagctccaaagtataagtatactcacatgccttcctcagaatagatcaaataattataacaggttagccttgggtgcaagaatttcaagacaagtcaaaatatcatattttacccaatctcaggtaacatgtatttcttgggtacttaactatgttgtcagacactatattgaacttttagcatgtattatctcattgaatcctcacatgtaattcatctggagctgttaaagctaacatttgctcccctatagtctgatgaaagactatttttctaccttccttattagtctcttcacatttggtttctttttcatctgcagttcattattgattgcaagctaaatcgtcaaagctaacacaatttccaaataatgcttcccagccagcaagaatcatgcaaaatgaaaagcagtgatttgacatgaagaggacaatttttctcacagctcgaacataaattgtcaccattcatgaactccagtagactgctcttcctttatgatttgttcttattcatgccccaggtgaacaggaataaagcccagggcactgagccagtgtgctgaacccaagacaggtggcacaataagatactagcctttaaaatatgcattcggttggaacctgcaatttcatccacttctaaaaatttttcccaggaatatagtcagataccaactaagatgtatcaatgatgatgaccaatccagtgttgtttacaacaataaaaattatgagcaaactaaaggaccaagagtagaaaactgactaaggacattgtgataattaataagataaattactatttagccattaaatatatatatatatacacattttaaagtatttttaacaatgtataaaatgctaaagatatattgctaagcagcaaacactatgcatcaagttataccatacattaacatacacatacaaaattttatataaaaataatttatacataatttataatatatacttttttatataaatcctatatataagatttttaaatatgaaaacaattcagaatttttttcttttttgacattttctgttttttaccttgactgtataatttttaaaagcaaaaagatcacttatgatatagacttcaattcaacaaatacttttcagtagcctattatgtaattaaattaagtttaacaaacatttctttaatgaaccatacacatgactgtagatataataaagagtacaacctgatccctgctcttgatgagctcacagtttagcaagaggaacgtataacaagtcaaaacaactaatcctaatagttgttatgaaagagcagtggagatacaaagaggaagtagtcacctcaaactggaaaagcaatggtaggtaaagagacaggaaggtattccaggtagaataaaaaacatctaccaatgtatgctgtcatgcacactggaatggaaagtaaaagcaagtaagtgggaaaatatgaagatgaagaagaaggtaggggcattatcatgatggactcttgaagcattaaggtacagactctacagctgcaccagccacatgtgaattgaattcttgaaatgtggctaatcctaattgagatgtactgtaaatataaaacaccacaccagattttgaagacttcatatttaaaaatgagaaataactcattaataatttttatgttgattacatgctgaaatgacatttttgtgtacattgggttaaattaagtatattatttaaattgattttattcaattattattatttttcataatgtggctactaaacatatattttaaattatacacatgactcacagtatgtatctactggacagcattgttctagaggatagattagaggaacacagttctggaaggaggaagaccagttagaaagcttttaaagaacccaggtaagattcaatgaaagattaaaccaggcaagtgcaaatagggatagagaggatccgttggagttataaaagagagtgcattgacaaaacaagtccagttcaataagaaatgaggatctggtaagtgtctggaatgccctcagttttttggcttgataaccataggaacagtagtaaccttagggaaaataaggaatacaaaaggaagaccagatctgtctgtaaagattcattcattcaaatattatttattgagcatctaccatgtgctagttattatttagctggttaggtgctaggaaactagcagtgatgaagcagatgaggtccctgctctcctggagcttacttacactctattacaagcacataaagagctcaatttagccatgtttaaagtgagatggctatggcacattcagataaaaatgtcaactagacatttaagtataaaatttaggagaaagataggaatggtagtttgagatctggggatcattgtggtgattccacctagagacagcatgtaaaaaacaaaaccctgaaaaacactagctatctaaaggtaatgtggagaaggaagaatcagtgaaaaatatagatagaggagaactaggagaaaacagtgtcaaaaaagccaaggaagaataaaattttaagtgtggtcaaccatgttcaatggagtagattggttaacccaatgactaccaagtatccatatgtagctacgaggctattgcttaccttttggaaggcatttttcatgggatggtggggacaaaacccaagtcacaaatggctgaaacatgaatggaggtgaggagtaaagtcagcacctgagtactgttcctttgaagaacttggctgggtaggacagtggctagaaaagataaaatctcaagagagagcctaagatgagagagattgaaatatgttttcgggtatgagggaaggaccagtggagaggactgaaaatagaggaaaacagaggaatatgtgatagactaagatcacatgggagttgaaagtagatgcgatgaaaagcactgggggatatattagtcttgacaacaaaatggaacacctttgcttgacactccaggtgtcaggaggaatttttaaaagacaaatgtgtagaaagaaggacttgaaagagttcctgcctgatgaccagcactccctgttaattaggggatgattagggaaagtagggagagtggaaactgaacagaaggcctccagagagggatgaaagtttaaaatagctgctgaagggaacagaagagcaaggtgacaatgaataaataagaagaatatccagtagtactaaggattccattgagattggggaccatatgcttatgcgctatgaatagctcctattgtgtgtttgttctctaactgtgctgaagagtccatatgtggaagtgaactaattaaatggaagaactggcccaaagtctcatatttgcagagcattgaaagcagaaagatgatttgggaatctgagggtaatcgtagcagagaagttcaaaccattgcagatagaatcttgcctggtagaagaagtgatcagaagcacattgattgatgcaggaaaaaaataagagggttaagaggttggaaggctgtcctgataaggctggtgagctgctagaaagaaattgtaaataagaaatgatgtttctccaaaataacaataatatatcaacaataataaatagctcttcattattaagcaattactatgtggcaggcagtgtattaaaatttttttaactttacatttaattgtaatgacaaccctgtgaggtaattactattattatatcctttttgttttcttttaaacaagtaaattaaagtactgagagtttaaataacttgctaagactgtagagccagtaggtggtggagccctctttcttaatcactgtacaggccaaaggcaaagacataaagatatagtttatttaaaaaggagtaaggtttcacggaaaacagagggaaatggacagtaagaaaataagtggagactagagaagcagagttcagaaagaagagtacacagtgaatggagataaagttagaggagacaagaataaatcattgaggaggcccacaattttaatggtgctaaaagattaccagaatgagtggcattgaaaaaataactgaccctagaatttttcagctttacaaataagattactggagccagctcaaagcacatacaatatattacagacagttcagagaataaagttgaaaggcccatgccagcccccaaggaacttacaatctagagatgaataaaacaagtatgtttaaaaagcacaaaacaagccaggataagaaaatgtcagaaagacaaaactaggggctctagggcttgcatttttaaaaacattgcatttgccttgagagatatgaaacagtggacatgacactcttgaatacataaaattgagctaagtagcaaagtgaggcagcgtatttacagagagaagaaaccgtataaacgaagccgtggagaggcaagtccaaggaatattgtagatcaacaaccaagacaagttggctggtttgccctgagcacagaaggggtacagaagggaagactggaaagataaactgggaccatgtagtgccttaggttgacacactgaactttattcaactcaaaagctaatgaggcacttatgagagggcccgagccagggaattatagtataggaagttcaggcccagagcatcattagaatatcctttctgctcagaattttatacttatttttcagaatgagacgtgctcatgtgatggagtacaatcttgagagtgatggaactcatacattttccacgatgataaaaatgaaacttctggagtttgttcattgccctatataaaaataaactggtttccttactttttctgtaaagagtgtttctggtctggggatctaagtcaaggagaaagaagaacatgaagtaaattacagtacactcttcctttgccacatagcccttaaaacgtcatgaaataaagcaaaagtgaatgtgaaaggcagccttttaaatagagaactcataagttaacatgcatctgagaggtacatggagaaatgaaaaattttgctttggtaaaaaacaagattgacaaatagacacaataaaaaatgataaaggagatatcaccactgaccccacagaaataaaaactatcatcagagaatactataaacacctctacacaaataaactagaaaatctacaagaaatggataaattcctggacacatataccctcccaagactaaaccaggaagaagacgaatccctgaataaaccaataacaagttctgaaattgaggcagtaattaatagcctaccaaccaaaaaaaagcccaagaccagatacacagccgaattctaccagaggtaaaaagaggagctggtatctttccttctgaaactattccaaacaattgaaaagaagggactcctccctaactcattttataagatcagcatcatcccgataccaaaacttggcagagacaaaacaaaaaaagaaaacttcaagccaatatccctgatgaacatcgacatgaaaatcctcagtaaaatactgacaaaccagatccagcagcacatcaaaaagcttatccaccacaatcaagttggcttcatccctgggattcaaggctggttcaacatatgaaaatcaataaatgtaatccatcacataaacagaaccaatgacaaaaaccacatgattatctcaatagatgcagaaaaggccttcaataaaattcaacatccctttatgttaaaaactcccaataaatgaggtatttatggactatacctcaaaataatgagagctatttatgacaaacccacagccaatatcatactgaatgggcaaaagctagaagcatttccttgaaaactggctcaagacaaggatggcctctttcaccactgctattcaacatagtattggaagttcggcccaaggcaatcagccaatagaaagaaataaagggtattcagataggaagagaggaagtcaaattgtctctgtttgtagatggcatgattctatacttagaaaaccccatcgtctcagctccaaactcgttaagctgataagtaacttcagcaaagtctcaggatacaaaatcaatgtgcaaaaaaatcagaagcaatcctatacatcaacaatagacaagcagagagccaaatcatgaatgaactcccattcacaattgctacaaagagaataaaatacctaggaatacaacttacaacaaaggaccctcttcaaggagtactacaaaccactactcaaggaaatcagaggggacaccagcaaatggaaaaacattccatcctcatggataggaagaatcaatatcattaaaatggccatactgcccaaagtaatttatagattcaatgctattcccttcaaactactattgacattcttcacagaattagaaaaagaaatgaattaaaatttcatatggaaccaaaaaagagcccatatagccaagacaatcctaagcaaaaagaacaatgctggaggcatcacgctacctgactgcaaactacattacaaggccacagtaacaaaacagcacggtactagtaccaaaacagacatatagaccaatggaacagaacagcgacctcagaaataacaccatacatctacaaccatctgattatcaacacaactgacaaaaacaaacaatggggaaaggattctctatttaataaatggtgctggaaaaactggctagccatatgcagaaaacagaaactggactccttccttataccttatacaaaactaaagatcgattaaagacttaagtgtaaaatccaaaaccataaaaaccctagaagaaaacctaggcaataccactcaggacacaggcatgagcaaagacttcatgactaaaacaccaaaagcaatggcaacaaaagccaaaattgacaaatgggattataattaaactaaagagcttctgcacagcaaaagaaactatcatcagagtgaacaggcaacctacagaatgcaagaaaatttttgcagtaaatccactacaaggaatttaaacaaatctacaaggaaaaaacaaacatcatcatcaaaaaattggcaaaggatatgaacagacacttctcaaaagaaaacttttatgtggccaacgaacatacaaaaaaaagctcaacatcactgatcattagagaaatgcaaatcaaaaccataatgagataccatctcacactggtgaggttgtggagaaataggaacacttttacactgttggtaggaatgtaaattagttcaaccattgtggaagacagtgtggcaattcctcaaagatctagaaccagaaataccaatgggattgctgggtatatacccacaggagtataaatcattctactataaagacaaatgaacacgtatgtttactgcagcactatttaaaatagcagacacgtggaaccaacccaaatgcccaacaatgatagactagataaagaaaatgtggtacatataaaccatgggatactatacagccataaaaaggaatgagatcatgtccttggcaaggacatgaagctggaagccatcatcttcagcaaactaacacaggaagagaaaaccaaacaccgcatgttctcactcataagaggtagttgaacaatgagaacacatggacacagggaggggaacaacacactgaggccagttaggggatggggggctaggggagggaaagcattagggcaaatagctaatgtatatggggcttaaaacctagatgatgggttgataggcagcaaaccaccatggcaaacgtatacctaggtaacaaacctacacgttctgcacttgtatcccggaacttaaagtaaaattaaaaaaataaaataaacaggattgaagggaattaggagccaaattcacatgtctgtatgaaccagttctctttttagcaatcttctgaacatcaccacacatctgtcagcagtacagaagccctcaaaagtcatggccaagggcacttaccaagctgttttttgtactaaggacaactctaagtgtaggacattgaaatatatttatgaacttaataaaacatgcttgcttttaaaatgtgtttaaaaaggactactacaaagcaaccaatgggtttgataacctgagttagatctttcctatatgaataaaatatatatttctatggaaaataaaagttcctctgggagaactgggtctagccaggctttctcaaactgtattccaatgatccctgcatcaagaccactagggattattaaaatgcaggtaccagggcctcctccagacctaaaaatcagaatctctgagtataaagactggtgatcagaatgttttaaaacttcccagttgatttgtatatatcataaaccttttgaacctatggtcacccagaagcatactaaagcaaaacaaaactggttggctgagagaaagagtttgctgtaacctctcttctaccttctgaattctgactcttttcatgaacaaaacttaaaagaatgagcagcatatttatatttgcaccctgagaatgaagcagagcatctggcaaatagcagaataatcagaaaaatatttgtggatttaaactgagcagcgtggtcatgaaaggcatagtttataataaataacatactttttttcacatccacatttcctctcctcttcccagccttctctaaagaaagagaatacttactgcattgtcaacagcgtttgcaccaggacctgtattttgctttttattcttggtaatgagccatgcatcccccatacctagagcttagtggattcacagggttgatgctagaaagtatagataaagcttcccacacttttctcttagttacactttgacaaacagtatctgtttcctctctcataaagactaatgtatgtggtatttgacatttaccttttccctttttacagaaaaaaattcacagataaccatctggctatacacatctatatctcacagactagaaagaattgtttcagttgttaatcatataaacattatgcctttggcagtttcaaatgatgtgagttttaagcagctaaacagtccttttggtgacaactaattactcatagtgtgtttatagcaaaaattgttttataaatgcaattgtcacttctattgacactttccatctcattggaatctacaagtataataaaaataatttattttgatcaattttccatctaaaaaaaaaaaaacaaaaataaaacctcagtcctgaagcactcttaaaattgtaaaagtatcatctttaggaaaagactaatatctgcttctcctgaactagcagccttttcaagccttttctttgtttctttctatgctgtacagaaattgttgtcaggtgaggaattgccaagaagtgaaatgacattataaatgtcataggtcagtacacaggtaaggaagaaagactgtctagaaagcaagctaactttttaaccaaaacattcttgttatatatctgtttttgtcaattatgttccttaatgtgcataccttcctaagaaaaaagtaacaaagaaagagaggttacatgttcagcaaaagatatgcaatattccatgtctatagaaaatattgtgattcatgaaaaaaaaaagttcaaaaagaaattgaaatgtattatgcctgacaaattatactcccttatggccttcaggggcacaaaacaaatctcaggcttgagtacagagtctaaaagggtcataaggtgacatgcgttacaaaaacattaaaccgtcctttagcttatggtgcaccttgcattatattaaagtgggaatataaaaatagaattgaacatttgggaaaagttccacgcttggaggctaagtaggttttcttttacaggactaagttcaacaccttataagtatcaccttaattcttccaaatcaggttcagtttcatgaaaagcaatgttctttactagctcataactcattttgggttccatctgtctttatcagaaagagtagcatttttttactttccatagtcatgcaggtagagagtagctctctgctttaattgtcagaataaaatgttttctgaggttaaaaagtgaattcaaagggatttcgaatgtattagtatcatgaggttatatagtatctctatttcccattttctgtcccatgcagatattattcaagtgaaatatgacacatatagacttactgacaaatctttcataaaaataaagcaagaaatttgaacttactaaccaggttaaaaatacacatttttaaaattgtatttaaaaaaatttttaggagaaaggtgaccagaagtatcatttttctaccttattaagctacactgaaaaatgtggcatgtaaaacaaatgagtaaagaccacctccaacgacattagaaaaaaacttccaaatttaagaatgattttcataagtttctcaatcacctaatgttctgataaattttacaggagaaaaagaggaaatttaagtcacagaattgaagttgctattaaaaaataaccagaagatttaagttttaaagtctcattttttaagaaagacccaaaatggtaaaaggcttagttcccaattccatgactgcattggtctgctggtacagacagctattttaaatcactcacaaaataatttatttgtaaaagttcaaagatttaatatatgttcaggcagagtgaatagaaatgcaaatattcttgatcacaatgaagctttttatgtaaaagcctgcaggatttgttccataggatattactacttcctcttattcatagttgttaagtaattacatttttcttatttattgtgttaaatattaacataactttttctctcatctctgtcacattacctcaatgaattttcttgaatatttctttcagcctcttaatgaatgacctattaaattcattattatgattatagtaaaccattgttactattcattcacatgacattatatattttaggaaagtactattatcacatgaattattttatgatcttttttatagcagcataaacgtcacaatggctttctttgccattaaaaatctcatgcagaagaattcatttgtcaacactaaccagcaaaaattatctgcattcacttaaagctacaaatacccattctacgtctacatcccagaccaatgcagtctaacctgcagagttcaaatttattttattataaaaagtttcctgcactttctgtgattgtctttcaatgcatggattcaatctaggtcaggtgcttccataggaagagtcaattttatctagccaagcattaaagatttttcttaaaggagatgttttatattgggaataatggaactaaggaatgtgaaaaagggcttgagaaatatacaggttgttattcagcatcagtcttattgcaccaacatgggtatacagcagctattgatgttgaatgtatttttttgttatgaaatataagaaaatttcagggaaaaaatgctcaagtcttgctgataacacatcctccagtatgtattaatataatgagggtttgagggacatgtcccaaatccaaaaacacgccatcaactgaaaccctgtgcagactacttaaggaaaaaaactagcatggctgtgattatactgccctctagtgtcaaaataaatgttatttacactgaagttcatttgcttttttcagatcagcattttcatgacccatttgtccaactatgggaatgaccgactgggattatatacatttgttaatctggccaactttgtgaagagctggaccaacctgcgacttcagactctgcctccagtacaactggcccacaagtattttgagctgtttcctgatcagaaagaccctctctggcaggtaaaattaattaaataattgatataaccagttaattccaggaacataattctgtgagatatcccaaatttgaaaagtgaaggcacctgaaaaaacctgcattttggaaatgttagtaaatttgagaaactactccttcctaaactgtagttgtatatcattgctacatattgcacccaattccctgttcccttgcacattggaaattatgggattcggaaagttcagtgacagattcaatgaatataacgtcttcaatcaggagtgagagataaatctacaggttgcaataggctggaagagtagaagatggtaaacaggtcgtttgttagacaggtagcctttgaacacatccccatatctctaatgactaaaccatattaaaggatctctgagaagagttcagaactgacatctgccttctgaaccacgaggtacaccaacagccaacagccactgaatgtggacagctttcaaaagtattaattggggattaatatgggggaaagcatttcatgggaaaatcactgagcttcttaagataaataccacatgaatacagcatattcagatgactctgggggtaacctagatttcaaagcatagactcttatgtatcatagaattgcaggaacaactttgaatttaaattgtccactccatgatctgtgaaaaataataatcttggcaaataattacatattgcttattatatgtcagacggggcacttgacatgtgttaactcatttaatcctcacaactaccttaagtggtaggtacagttatgatttgcattttacagatgaagaaactgaagcacagaaaggctaagtcaattaagcaaggtcacacagctagtgtgttgcagagcaggaatcagttgtaggccatctggttccaaaagctgtacttcttaatcactgttctaaacgctactagagttacagacagagctgatggtaaaacaataacaatcatcagaagtagaactcagtaactttttaccacagattgaagttgttaactctgaactttatactcaatgcattcagctttcaaccgtaagttaattacctcctgagcacacacagatgactccaagagacataactgcatatttagcaggttaaagttggtggttgtggacttatgactgcatattacttttccgttgttttaacaagcatcttttcattttaaccaccacgaaacatcaccaaatgttagccaatggaaagacatgcaattttcctgctaattcaaccttacttttaaactgaaatcattatttcaggtgacaagttttaaactgtttttttgttttttttttcagaagaacagccaaaaagaatactctcactttagtcttaacatctgttgcttattaaaaataagcagaagtcttatttaacttcacatacctatggtattaattgactagaaataaaaaagtggtactgtttgcccattcctgaaataatattaaagggtactgtaattcttcctccttttctacataatatatactttgttcttaaaatgaagggtgttctaaataggacttgtgcagtggatgttggtgttaaatattatagaccaaaagcagaatccctaaggtagtaattcaccctcattattcccttttgctaaaacttaggactttctagcatcatagtctataaagttacatttttagatatacatttatcaacctttgacggcagctgagacgtatctgctgtctctttagatagtagtattttggccagatccctatccctttgaagcacagctggaaagctcaaagttacttagaataaagatctgacaacttacatttcagttatgtattgaatactgagtgtatcatcttttaggttagcaggaagcataatctctgcccagtaagctaactattaaaaaaaatagaactgctagtagccaattaaactcttcatgctatgagactgtttacccaaagtggaaatactgcctctctccagcctgctctgtagactctcaacctcaacatggaagggagttattcagaacttccatgatgccacttcagggctttcatttttttaaaagagtctattttttatcccagcgtttcctggtatacttttaaagaacacaagttggaaaagctggcacacaatggacacattcatgaaaaaaaatacatctctatgttcttctcccatttagaatccttgcgatgacaaacgccacagagacatttggtctaaagaaaaaacttgtgatcgcttaccaaaattcttggtaataggaccccagaaaactggtgagaactttttatgttatgattaacgagtgtaaattttctgatgactagacaatgagatcttgtcacaataagttcgtaaacttcccataactgctaatgaatgaataacatgtttttctctgacataattttcatttagcccagtaatatacctaaatgcttatcgaagtgttttttaagtgaagggaataaaacagatgtcacactgttcaaatatccagcagtcaatttggtagcacatgtttttttttttcccccccaaatgttttaattgaaaagtattgtaattaacacttctaaaatcaaagctgatcactgacaggattgtatcaaaagtcaagagggacacagataagtacctataactctttataataaatcccttctagaaaaatagtcccttaggctgccattttcctaatattgtttatttgtaaactatttcttgcagagatgactattttttaaaagtctaaaagatatttcacaagcagaattcctagacatacacaaaactttgtgctaagaaaggtgtttattcatacccaggagaaatcttttgcaccttttcttaaattgatgtgcaatttttttcaccataaacttctttatcaccataaacttttttttttttttttttttttgagacggagtctcgctctgtcacccaggctggagtgcagtggcatgatctcagctcactgcaaactccgcctcccgggttcacgccattctcctgcctcagcctcccgagtagctggggctacaggcgcctgccaccatgcccggctaatttttttgtatttttagtagagacagggtttcaccgtgttagccaggatggtctcgatctcctgacctcgtgatccgcccgcctcggcctcccaaagtgctgggattacaggcgtgagccactgtacccggtctataaacttcttgtttctaagaatcagtattaaaatgaagcatcatggaagctttaaactaccagacattcatgctatatcctgcatgataaattatttggggcccttggttactggcttcacagaaaacagcctttacaatcatattgcttgctaaggagaatacattccctctcctcattgatccagaaataactgaggaaaattctgtgcaatgtacacagggagttcagcatgttcatttttttccttaatgtcatttgcagatatcaatctgaaaacaataataaacatgacaaatacttacatttttcttgtccttatttatttcacttgtccttatctatctaaagtcaaaaggcaactaggaaaacatttaaactaaactctcttcagtgaactcccagtcatcacataaccttgtcaagactgataacatcctgaaggcttggtagcattttgctttagaaagtcctgcaggattcgcttcctctcgtgttgtgctggatatgcagacattttgatatcatggttagatggtagaattattacttgtcctcttaaactgaattgggtttccaaatgtttgttacaatttggatatggcatttgtcgttggaaaagaccttttatagaaattgattcttttttatagaaattgatttttcccagttttgttgaatataatttacatgcaataaaatccacccattttaaatgtacaattagctgaattttgaacattgcacacagttatgtccaccaccacattcaaaatacagaacagttgttagcctaaaaaaatttctccttgttcctttgcagtctatcccccccgatccccaccacatccccagccacaagcaactactttgtaccactacagttttgccttttctagaacttcacataaatggaagcatgtattccgtgtagtcttttgtaactgacatctttcatttagcataatacttttgagattcatgttgctgtatatatccatattttgtgaaattgattttttaattaaagtagtttctcatatcagttacatgagaattaaatagcttcatttttaactgtacttttgtcaaaagtatttttctgggccaggcgtggtggctcatgcctgtaatcccagcactttgggagaccaaggcgggtggatcacctgaggtcaggagttcgacaccaccctgaacaatatggtgaaaacccgtcactactaaaaatacaaaaactagccaggcgtggtggcgtgcacctgtagtcccaggtactcaggaggctgagacaggagaattgcttgaacctgggaggcagatgttgcagtaagccaagatcgcatcactgcactccagcctggacaacagagtggactccatctcaaaaaataaaaagtatttttctggataattttgcagatttctagttatctggatattcaagtatttttcagtgttgaggctgacaaaaatataaaaccgaagatttacagatggttatttaaatgtgtgtctatgattatgtagttgagttaccactgacaaaatatatatgcaggacagtttattcagacccaagaatatgtacaggtaaagacagaattcagaaaccacaacttaacaattttttaacacttataaattcattatgccttttactgactatgcaaaataattagattacatccattttttctgtttgtctaatgctggtcatgaaaggctattaaaagtgaacaaatgtatttaatacaattcttaaaaataagattcagaaaagaatgttttcagttgatctaagaaaggaattaatctctctgctttttttctcacattataatggcaatacttatttccaaaaagatatttttaactttaaaaatgcctcatgcatttttctggattatatctcatgtatgtaattgagattcaaatgtatttaatgtatttatttattgtaattctaagttatatctcaataaagtttttatctggaaaaatgccttttaaatattgagatatggcactctttaggtgatttcacctaggttacctcgctaatcctcataaaacactgatagctaagtattttcttccccactacacagatggaaaaactaagactcaagagaggttaaataatttttgttcaaattcacacagctggtaagtacaagaataaaaatcttggtcctagaatttacctgacttcaaaaaacatgctttttctactttaccgtggatttcatgtaatggagcttttttcctccaataaattttagatattgcttcatagttattctaagtcagtgattctcaagggtggttgccagagcagcaacataagcatcaccagaaaatttattagaagtgcaggccaggcacggtggctcacgcctgtaatcccagcactttgggaggccgaggcgggcagatcatgagaggtcaggagatcgagaccatcctggctaacacggtgaaatcccgtctccactaaaaatacaaaaatttagccgggtgcggtggcgggcgcctgtagtcccagctactcaagaggctgaggaaggagaatggcgtgaacccggcgggcggagcttgcagtgagccgagatcacgccgctgcactctagcctgggcaacagagcgagactccgtttcaaaaaaaaaaaaaagaagtgaaattcttgggttataacaaagacttaccgaatcagagatactgggatagggctgtgctatgttttaacaagcccccagatgaatctgatacatgctagttagaggaccactgttttaaggcaagcttgtgaagcacatttttactttgtatatcatagattactgttttattccctataatgatctatgattacagacaaactgttcattgtttggctcagatataatctaggaagactacctctttcaattcattttttaagacaatattgctgttgacagagttattttaacaatttttctattgtatagatatggtagatttaagtaaatattaaagaaagcttaatttataaatacttaaatagtatttatttacttaaatattgccatatttgtaccatttaagtaaataaacactaaaatactaccttacttccatattaatactatttaagggcggggcacagtggctcatgcctgtgatcccagcactttgggaggctgaggtgggcggatcacctgaggtcaggagttcgagaccagcctggccaacatggtgaaaccccgtctctactaaaaatacaaaaattagctgggcatggtggcaggtgcctgtaatcccagctgcttgtgaggctgaggcatgagaatcgcttgagcccaggaggcagaggttgcagtgagcccagatcgtgccactgcactccagcctgggcaacagagcaagactccatctaaaaaaaaataaataaataataataataatactatttaagtaaatactagcatattaatgctatttaagtaaatactatactatcatcttaatactatttatactactattatttaattagtactattaataataccatattaataccatttaagtaaataaataataaagaaagcttacctgaaaaataagaaaattcaaagttttgtacaaatggcaacatgacataattactaagcataattagagtaatttctccaagtgagagaaatattataaggccatgtcttgttactattgctagctattgacttggaatataattatcaagtcctgctccacagattgtataacagtgtaaataatagtatatttctctcttaggagtagccaatatatagaaatacttttatattatgatcttttaaacacagtcacagttacaagtattaaatacatggctaaatctttgacaaactgaacccaaactgccttactttctcttgtaccaatctgactaagctacaccctttatctcctcatttagtcttataaaaccctaactgtacagtttatgacattgctcactttttgaaaaatcacacccttgctccccaatagtcacaaatatatatacgtacctgtgatacaccattctcttccctagtaaatgcaaattctataagttatgtcgctaagaaagggcaccatttttttttccaatttagcaatttaaacaatttttgacactactaagtacattgaagcttaagcaaacttgtggaaagattaaattctgtcttgagtttaattagctttcataggcctctggaagaacttaatatgagaacccaagtattgattttggtaatgtaatatgttaaataataatatatttcatttatatagtgccttattaccgtcaaaatgtcttcaagtacatgttctttcattctcagagaaaatctatgaaataagtaggcaggtgattttccattaagaaagctgagacaggtcaggagaggtgactcactcctgtaatcccagcactttagggggccaaggtggaaggattgcatgagctcaagtgttcaagactagcctgagcaacacagtgagacctcatttctactaaaaatttaaaaaaaattaaaaattagcccggcacagtggtgcatctctgtagtcacagctacttgggaggctcagacaggaggatcccacgagcctggtgtcaaggttgtagtgagccatgattgcaccaccacactccagcctgggcaatatagtaagatgctgaaaaaaaaagaaagaaagagagagaaagaaggaaagaaagaaaagaaaaggaaagaaacaaagaaagaaagaaaagataaaaagaaaactgagacaaacagaagctaaaagacaaagtcacagacaaatcagtcattgagctgagattgaaagccagttctctcaatccctgcaacaggcctcttttcacaccacactatctccattttttagaacctgcttctattaaactgccgattatctattcaatttatttccagcagtagttgtaataaatctgtttggatcattctaatatttattcatgactttaaagtgttgatcataggaaattgtgttttcatttaattaatttctgaacctctattgtctttctaggtaccactgctttgtatttgttcctggttatgcatccttccatccttagtaactcccccagcccaaaaacctttgaggaggtacagttctttaatagaaataactaccacagggggattgattggtaagatgggttattagtataaatctaaaagtatatgtactgtgcacagtataaacttagcactaatatttagaaacatctaagtttgtagtcacaaataaaatttaacctctgtgccttggaaattgattgaatatcataaaggggctcagaaatttttcagaacaaactcttctcagtttataaagagacttgttataccaagaggatcacatgtaatttcaattggcattaattttctttgatggtaattatagatattaagtcagaagaatagcataatattcagaaatttaattcctttctactcgtaaggaaaaaaaattttcatatatttttcttcttgtgcactttttatgaagtgatgctacagccaacatatgtaattttctattttctttgtcacataaaaggaaaaataaataaataaaactagaaatgtttgtatattacatgagtaatcaaagctataaaaaaaactatcaacaatacacagaatttaattcttgcctttgaatcaaaattagaaatatatcaaccatctgaacaaacacttaaaaactaaaaatgtcagaatacacaaaatacagtaatgtagtagagatagatggtacaaactaacatgttaaccataaaatgtctctgaaggtcttgctatgaaggtataatgctgaacagagggtggtataaaggagtgaattataataattctgcagcataaatatattttgcatgtattttagcatagtcatatatatctcttgtcaaactgcatgatctcaattttataattatcagccccctgaggagctgcttatgagaagtccgaatggaaaggaaaagaaatggattgagtataatttgagcacctactaggatttacatatattctaattgttatatatttcactgccaatttttcagttcagggtttgatattgattaattgtgtggtgttacataacagctggaaaatcaagaaaccatcgacagtggccaggcacagtggctcacatgtgtaatcccagcattttgggaggctaaagtgggtggatcacatgaagtcaggagtttgagactagcctgggcaacatagcaagaccccatctctaacaaaaatacaagaattagccaggcatggtggtgtacacctgtggtctcagctaatttgggaggctgagatgggaggataacctgagcccatggaggttgaggctgcaatgagctgtgattgcaccactgcactccagcctgagtgacagagtgagaccctctctcaaaaaaagaaaagaaagaaaccatcgactacttcagctgtatttgatcactgactcaaatatacatgccagtatataattatagaataaaatgatattaacatcaggactaaaaggactgaataaaaactgctttggaggtggacaggaatgtattagtattacattcctgtcaataattggattccctaggatgttttttcaaagaacatatttttgaaaaatttatggtaaaaaattattgcaacagttattcttaattttttaccataaattttacaaaaatatattttggtcatcatgtggctaggtactctaataggaacaaaaagtccagctgggcacactggctcacacctgtaatcccagcactttgggaggctgaggcgggcagatcacctgagctcaggagttccagaccagcctggccaacatggcaaaaccccgtctctactaaaaatacaaaaattagctgggcttgttggcaggtgcctgtaattcgagctactcaggaggatgaagcaggagaatcacttgaacctgggaggcagaggttgcaatgagtcaagatcgtgccattgtactccagcctgggtgacagaaggagactccatcaaaaaaaaaagaaaaaaaaaggaaggaaggaaggaaggactgactcagggttgacccaaataacaaataaatgtggagtattgcaaaaaaaatcccatttttcaggtaaaagaaaatgctgaagttttatgttttatagaagtagaaaaacttaagggaggcaggcatttgcttttaaccctgaattgttaaaacactccagtttgttcactaattctttgaataacctgaatttacattctataaatgtgagcctatttgtggagcttcaaggtctcatactaaaaatatgaaccttttatttacttctctattaatcgaacatctttcaaatgcctgtaagtgccagcaactacactagaaaaatgcggacatataggcaaacaagagctgtgccctgccctctccatgagcccctggggcctggcaaaatcaacacattataggtccaagatccagacttgcttgaggaggttttcaaagcctaaactgttccagatacaaaagacttctaggaaggtatggcaggtttaagaagctaaaatttctgctcttttgtgtgatttttgaagcctttttcagaacaagcaagtttgagtcaagcttggaccaaataagataccactagacacttgaaataatcttagcactcctggaaccagtgtgagcttctacataagaagcatcctgaaagttggcactctccgtaaatagaatgtacaccagaacaaatagcacatcaaaccttccagaaatttttgtatatctctttctccctaaaagggtgccagaattacatatcaccaacaagccaattccagacaacataaaaggatttctttactgctctgaatctcaagatatcactgtgttgcaccagctaagctttgcaatatgttaacaactggaatcctaccagaagctttatcatgtttgaggatatgatctcagtcaaaaatctatgaacatctcatgtgatcttttggtcaaaagaaaacaagacactgtaaaaaaaaacaggtcattgcatgaatattaatgacttttttattcagtaattattgaactaccttgtcttggtagcccagtgtgataatggcttatgaattgaagggggtggcaatggaggctgagaatccctagaagctatatttttacagtcactctaaaaaatcccttttcctctaaaggatgttccttagtgcttcagatatatttcttatcatatgctgaattagttacatttgacaacttttattcaggtggaacattaaataaaattctacatttcagtgcttgaacctatagatatccctgtgttcattctgctggtaatttgaattctctctacccatgaggatatagaacatgaccttgggaaatttgttagagttttatatttggaatgtacatagtttttaaacttctcttacaattattctaaagaggaacataagtggctctatatgagaaaaattaagcaaataagcaatatttataccagatatactctgcatctttcacactatgtgattaaacgtaacaccggcacaatacatttgtagaaaagaaattatttcacttgcaataaagtaaaaaatattttctctaaatccttttaaaatgtctgaactgaacatatcgtctgttttaatacgattttctttttgagtacttgaatttttctctgtacagtgtttctacattgagacacatttgatatagttaggtcgatcactgttgcagtttgatcactctgtgtctacatttttgttattgcttatattttttcctgatattaagcaaaacataaagaaaatgtacttagaaaaacatcttccaaacacattattagtgttctagatatttttctcttcctaactatggaggacaaatgctgtaaagaaaaagccttttatttaggaaacacatgaatttgtgggacacttttaacatctttggtcaccagaatgagtataaaccagaatcttattttgagaaaaatattccttttctaggtatatggatttcttcccagtcccatctaatgtcactaccgactttttgtttgagaagagtgccaattacttccactcagaggaagcccctaaaagagctgcttctctggttcccaaagccaagattatcaccattctcattgacccttcagaccgagcatactcctggtaccaggtaaggaaaatgcaaataaaatccaacagggagaagtggagtatggacaatggagcattgtttttagcaatacccactagctcaggttttcacaaaagagatttgctagttgtttgatatctacagaaaaatggacaagtttttcttgatttctattgagaaatttcctccactaagtttttgttcttattttattaacttaatcaattaatttaataaaatgtattaatgcaataaaagaaactaaattaaaatataacaaaatattatgtacttttttatatctatgcctctatatatctgcattttaaggtaataatttaaaatcattattttttcatctaatacttgtgtactctataaagagtcagattgcaacaagttcagacattgaggtttatacagtctccattgcaactctaccattgtatttcgaaagcagccatagacaatatgtaaatgcataagcattcctgtgttccaataaaactttactgaataggcagtaggccatagattgctgaccctggctctaaaacagcttaaatagctacttgtactaaagaaacagcttagtggcaaaactaatatatataagaatctttaggctgggcgtggtggctcatgcctgtaatccaagcattttggaaggtgggaagattgtttgagcccagttcaggtgggaagactgtttgagcccaggagttcaagaccagcctgggcaacatagggagactctgtctctacaaataaagaaaattagccaggcatggtggcacacatatgtggtcccagctacttggaaggctaaagtgggaggattgcctgagcctgggaggttggggctgcagtgagctgtgattgcagcatgtactgtgcagagggagactctgtcaaaagaagagagagagagagagagagagagaaaagaaagaaaagaaagaaagaaagaaagaaagaaagaaagaaagaaagaaagaaagaaagaaagaaagaaagaaagaaaaagaaagaagaaaaaaagaaagaaaattctacatccctgagagcctaacatgtctaaatgtttcttgtatactcattgccattgttttctgatgttggttagaaccttgcacaaaaacgatcactttgaaataatttaacaaactctagtaataatatatatgtcaaatacacttttaataaatcattgcaaataggaaacaatcttttaaaacttgtttcggtgataatttaaccaccagttggaagggtttaatatgaagcagtcaaaattaacataagaacatagtaaaattaatagagtcaatgtctttagtctctaggacccttagttctcatttctcagttttgtaacttaaaaaatgctttcctactgttcatgtgtttatccgttcatcaagtaattttaatgactaccatgtgcaaagttttgttctaagtgtgatttgaaaaataaatttgaagctatacttgaaattgctttcagcctaattggagaaatatgtataaacaagcatataaattagaaagtaataagcgactgacatacagactccttcggaatgacaaagcccacctgacaaagaccacctgggaaaggctgtcgcagagaagcccaaataccagaaccatggggcactttcttaaataagggaaagatacgtaaggggatacatttaggcaaaattaaaatgaagaagtgttttcataggtgcaaagcagagctgtgtaaaggagttatcatcaggtcagtgctgaaaagcagactgagggtcctattttcttggaaacaaaaatgttaagacaaacgtggaatgttctatgtacaaaaacctctaatctgaagtctgcaaataggctggatatatgactgcttccctgtgttaaagtgacccacatagcttagatcctccctacaagagtgggatgttccattcttattgatttgatttaaaacagctaagttcttgacaatcataatattagagaataaagttgctcattactgagtccttttgctacttaacaaaagcagtttttgaagttcacaagaggaagaacagattgttggaaaaggttttgtggcaggaacatagtagggaaaggtcataaaagcagatgaaatcttagggattttgataataatctgaaaaatagcgagtggagacatcctggaaagctaagatccataaaaatccaccattctatactaatcattcacgccaaacctgaagccatcttttaaatcaaaacatacagcaaattgcaaattgcctgatttgattttgcaacttctaccttttccaccaagtatctggagaaaagagaaataagccttaattgactccaagaaaaagaagaaaattggagcttggcaaccacttagtccctgaaaaatagagaatttacagaaaaagaaggctttaaggctgcaagctaacaaaatgtcctaaatattacaaataaatcacagtggcaaaatgcaggccttaacaaagtctagtagagtttgtagtccagtgatttgaatctcaattgcagaaaatttgctattcaactagatgaggtaaacatccacaaactcaccactaagcctgaatatttattggccaatttaaagaaaaggtgatttcctcaaacccatgggcctaagcctgagcaatcctgttggattgctgctttctgcattttctgcacaataaatgattctgattcaccgcaaaggttaccattagataaaataatcttggcttttagatatcagggaatgtatgataaaagctgtggatttcagataatgtacatgtcagactttctagtactttcttcatttaaaagagctgataggccttttctaatctaaaactgcattactagatggagcaaaactatttggcagaggtagtagggtgcttctctattatagatattcactggacactataaatggtttgcttatgagctggaaagagggcattaacacagctttcaaaagtttactttcacaataaaatacatacactaaggaaacaactcagtaatgctggtgaaggaatcctatcgataggaattcaacttctaccagataaattctcaaaaatttactcccataagtatcataactttaaatcctgatgctccaagcaaacattttcttcctttactaatttcaaaatagataactctccagcagtgaggcacttctttctttagctttgagacttgtcacaaagattgatttttaattatttatgcctacggttcagattagtttaattatccaccttttcatcatagcatcagcgatcacatgaagaccctgcagctctgaagtttagcttctacgaagtgatctcagcagggccccgtgcaccctcggagctcagagccttgcagaagagatgtttggtcccggggtggtatgccagccacatcgagagatggcttgtttatttccccccatttcaggtatggagtaataaggatttacatcatgttagaatctcattaagttgatgactttgccttaaggttaagaaaattttcaattgttaaactattactagtttttcctctttagttgtaaataatgaggctatggcaaagagaaataggcagaagtagaaaaactttaattttctaagagtatttcagaataattctccctgctctatttgctgtgcgtacctttcctgattgtaaaaagctttgaaagctttagatacgattcttatcctgagaataaagtttgaaagagaacctcttaaccaaacaagacaaataatgttttgcttaattaagtgccattatttcctttttgaaccaccttgctgaatttttgataagtcctatgtttttctcagccccttgaatttcttctgcctggcatcaacctagattgcaaaatcagcccctcatgggatcatgtaagcaatccagacacatcagacatggtatatacctgtgagtctagagccatgctttccagtatgacagccactaccacatatggctattttaatttatattaaaatcaaataaaatgaaaagttcagttcctttagccacattttaagtgttcaatagctaaatgttagacccagcagctatagaacatgttcatcatcacagaaagttctattgaacagtgctggtctaggctaaacagaaatatcagagaagaggtatggatagacaagacctgctttgcaggctttgtggcctttaatcctggtctcctctcatcttgctgggtccaccctccttggcataacaagcaacttcttcttagtttcttgaggaactttgtccatgttcaagtttcctgagaatctaaccttattctccatatggattatcgaaatatttcttcaaacctgacagtgctattcctgaaaggaatcgtgaggaatgacatgttctctgtcagattacatctgagtttattataacctttcttcttttctattgtactttccagcttgaatgacaggatcactgctttgtctgttttgaaagttggtttccatttgtgattttctagtcacttttctaagctctcttggtctttcaactgccttttttgttttcatagtgtgacttctcagactgcaaacctgagtgtacttaattggtgtgatttatttcttattccaggtcattaatgaggatgacctggattctatctaacaccaatgcatgcaattctgctcaggacagtgtctctcactgaatgagtttagaatgcagaaatttttcattatacagtttacatgtcttttttcaatgtgcatttttttatttgataatttagttgctaattattgatgggcaacaactaagaactgatcctgctacagtgatggatgaagtacagaagtttctaggagtcttgcctcattataattactcagaagctttaacgtaagtttatattctaattagtttattgacatttcagcagagaattgatttcaaagaaattgcagtttggtcatacaactgtcaggttacttgttccttatatactggttatttttcaatttgacattaaccacggaaaaaaaaaacatttcaacagtgtgacacagaaatgtcctaaatcctgtgttaattcctaattgtacaaagatttccctgaaaggaaagtagagaaataaaacagtggtaaatcttaaaacaaaccacaaaccttaaaagaagttatctgaaataaattcgtaaagcctgagcctatttaacaggcaatatggggcttcttggaagtatgaacaggtgagtaactaggtagtttaggaactgactcttctctcatttgtgtaattttcagaaacaatgtcatacagcaagaaatagtccataggtgattgaataagcagagagagatgtactattatcgctcctaaacaaacgtccttttttattttttcatctttgtctttatccactatttgaccctgtcatctctgcttcagagtcctcagcagttaaagcactggtttgatttttctgtttgtttgtatggttttttgctggtttcctccgattttcttaggtaactgactctgtaaggtccatgaccagggaccagtaaggaactagggctgaagaaggcagtcactctcggaggtgtgcccatgcctgagactgagtgctgtgtcctaggtgcctctcttacctcaccctagtgctgactctgggcttcacttagcatttttgaagaagacctctatcttactgcgtccatttagaatagttggcaatcagatttaggagaattatatttgttcctaccacatgtgtagagcaactggaagatactgagttggattgggtcatggacctgactcacaccgtaagttggtttttttttaattacatggactgagccttaaaaaaaaactgaaaaagactatcatggaatttttccattgtgtttttcagtataaaactcagttccacagatcgagtagttttccctttttttgtactctttaatatcaatttagaaagtgagaggcaggtttcctttacctttcaacaaactttgcaggaaaaaaagattagcaggaaaacatcaaatactgcttatatctcctacaaatcaaatatagagacacgtaagggaggcattttgctgtagaggacaaaggagtaggtggaactctgcagttttgagcttccttcctaagagtcatttatactttgctgttattattaaccttctgacctctgtgttttctatactatgagtactgtcagagttttgtatagcttagttcaagtactaacacagacactggccttaggtatttaacattcaacttgaccttaaagaaagctgagtgatttcagtttgcacttaaaaattcaagaccattttctgttctgtatctttttaagcatctcttggaaaagaaagcttttattttctaaacagttttctatttcaagttaggttatctgtgggtcttttttatagagtatgtagcaaagcattgtatttcagaaaaaaagaagtacagtattctataaagacagagttgctttttcttatgggatggtccttgacctgcatgctgtgtatttgtcccctctgcagccagctcagcagcaagctttttattcatctccactgctgagaaaaggcagtgtaaacttaagagaatatcaaagcaacatactatatacaaagaaccgtagtccgtttgcacctgagctgtatctagctaaaattactgattatatgattctctaacctggttgggggctcagtgggtgaaatagcaagataagatatgtgtagtccctgaaaccacagtttctattccagcagtgccacccaggctctcaccctgcaggtggagatactgtgtttccattccatttctttttatattttcttgtcaatcatcaattggcctgacataccttgtaaaacctggcagtgcactagttgtagaatatttggaagtttcatgtcattgtcttgggtctaaattgatcatccttcaccctatgccctttgtagttgtttatctgaaacctgtcttcacaatttagttactcctattagagtaactatactgatagctgtttctgtagtgctttggaaatactgaggatgactagaggtacaaaatatatatcgtcagaaatgccatttataccagtttgtatactttgtacactttggtattgcttcttattttttcttcttattttcctgctggtgataatgacgactatctcattggtgcttaaaattttttttttctcattggaagtcctctaaggatatagtaaactgtaaaccaatatgaattctcaactaactacataaatctagtgctttgcatgtagtagaataaatgaatgaagcaaggtctatacaaatgttttgctatgcaatcttggtgtgaaagagtactccaatttaagatatctctaaacttattatcttccatatagcaaatttcagcatcaaaactattttcaagaagaatcacaataagcccccaatgtcaagattgttgtttattcttttccacaagtgctaaagaaagcgttcaagacttttaaagatatacaaagtcactgaagaatctgtgatgtcttaaaatgacttattactgttatcatgggtgttaaatgacatatttaatgttaaataatctgattttctcagtgattgtgtgaatgaaataagcaaaataagctttaaaaatataaataagaactttctcattcaatcaagtaaattataatttacaactcttgttccacatacccttaatccctaaatgggattaatatattaacattactttagtttttgtgttacatgttatatagtgttttgaagcaatcatttgaaataagacaggaaaaacaatgcttagcatggaattgtactaatttgtatacactaaaatgaaaaatatgaacttttagttttgccatgaatacatctgttcacaataatacctagccatcaatgccaatgacagatgtcttcatgtttagaaatactagttagctaaatacctgaacctggcatctttatgtctcagtcagttaacctatttgtcaagatgaatgaaaccagactatgttatatgaatttttagtattaatttactttgaaaatgtcaataaatgggcaatgagaagttgaaagccgagagttgagtatagttgtttgtttgttttgtggacagaggttagctaagtcacgaaggactgaagctgcttcaaaattcagaaggacttcaatagcttttaatataacttccttggcaacgaaatttatattgcccgggaattgttttcctacccactgtagataaattttagtacaaatgtactacactaaaactttcttattagcaaattatagtagccacagtaactaaaatctgctggttctctggatggcatgaaagaacacctagaaatgctgagtagggaaaagaaaaaaatagtctattctaatttcttattataaatttttaagtggttgtaacagttcaaaataaatatacatttatatgtcctatatatctctctctcttcataaaaacacaatgtgatacgtacaattagctccattttttcagattaaaaaaaactggggcacaggaaagttaagccaaaggtcactcagcaagtaagttgaggaggcaggattgaaactcaatcagttatctctggaacctacattgccaacctgttaagctcttcatattggcacaggatgttagaaccacagaaaaacaatactgtgaatttttaatagtgaatagcatattaacaggaagtgcttccttaaaaagaactagagccttaaaatgagctatggaagttgtttcagattttattatgaataaaatccatttccaggtgcactggatgtcacttttcttcataaatatgtaatcataaagatatgcaaattaaaataacattgaaataccactacatacccactaaaatggctataatccaaaagacaataccaatttactgtattagtccattctcacgctgctatgaagaaatgccccagactgggtaatttataaagaagcaagatttaggctgggtggggtgtctcacacctgtaatcccagcactttgcaaggccgtggcagatgggtcacctgaggtcaggagttcgagaccagcctggccaacatggagaaacttgtctctactaaaaactcaaaaaattagttgggcatggtggcaggcacctgtagtcccagctacttgggaggctgaggcaggagaatcacttgaacctgagaggcggaggttgcagtgagccaagattgcgccattgcactccaacctggggaacaagagcgaaactccatcaaaaaaaagagagaaagaaagaaaaagaaaagaggtttaattgactcacagttttacatggctgggaaggcctcaggaaacttacagttatggcagaaaccaactcttcacaaggaggcagaagagagaatgaataccagcagcggaaatgccagatgcttataaaaccatcagatcttatgagaacttactatcacaagagaaactgccccaatgattcaattacctccagctggtcccgcccttgacacgtggggattattaaaatccaaggtgagatttggtgcggacacagagccaaaccatatcacaaatgttggcaaatatgtggagaaactagaatcctcatatactgctaatgataatgcataatatatggccactttggaaagcagttttgcagtttcttaaaaactaaacagaatctcactcaacaatccaatttcacttctaggaatctaccccagaataaatgaaaacctaagtccataaaagctagtaagggaatgatagcattattcataatagctaaaaactagaaacaatacaaatgttcttcaactggtgcatggctttgttatatccacacaccaggggggtttaaaaaaaaaaaaaaaggaatgtccagaaaagagacaaatgtagagttagaaaaggtttatctgggccgggcatggtgactcattgctgtaatcccagcactttgggaggccgaggcaggcagatcacccgaggtcaggagttcgagaccagcttggccaacgtggtgaaaccccagttctactaaaaatacaaaaattagctgggcgtggtggcgcaggcttttaatcccagctactccagaggctgaggcaggagaattgcttgaacccaggaggtggaggttgcagtgagccaagatcgcgccactgcaatccagcctgggcgacaagagtgaaactctgtctaaaaaaaaagaaagaaagaaagaaagaaagactttatctggaactagggatgacagcagggattgactgcaatgggctgcaaaaatatgggttttggaaggatagtggaaatgttctaaaactggattgtggtgataattgtacaactatataaacttgctaaatagtgctgaattgtatatttaacaatatgtaaataataccttaaaaaagttgttaaaataaaatgcatatcagtaaaatgattccttaaatcataaacgtgtttgccaaaagagaactgattttaaaaaactgcaatgcctatcctatattagtaatatctaaatgatggtattttgattttgaaatttactgaattgctattttcaattcagtattcacccatagaaatggtttttcgatgtaaaggcatttcagacatactttagtcttctaagtgtaatctgaatgttttgtacgattaacccgcacgagggtagaaataaagtcatgttttcattaatataaaaatgtcagccaggcactgtggctcacgcctgtaatcctaacactttaagaggccgaggcgggtggatcacctgaggtcaggagttcgagaccagcctaaccaatatggtggaaccccatctctactaaaaatacaaaaattagccaggcgtggtggcgcacacctgtaaccccagcaactcgggaggctgaggcaggagaattgcttgaatccagcaggttgaggttgcagtgagccaagatcacaccacttcactccagcctgggcgaaagagcaaaactccatctcaaaaaaaagaaaaaaaaaagtcactgtttagaggttgaatcattggagaatcttggtgcccctgcccacaagtcttttacagttatttctaaatatcccagatgatattccacacaagctttagaaccattcttacccattcttgttttactctttaaatcaacaaaatgttattgaataattatgtgcatgactctggagacacaatgatgaacaaagtatccccacctccaggttagggtagccctagaagcggacactaaacaatatatgaacacttcctccaaaatgttcactgcctgaaggccttgaaaggagggccccagccatgacaatggttgccagtgcttacataaaaagatagtttccttgctgttccaccagacttcagagaaacactgctgctttctgaatagatgtggggagattttctccatcttctattacacttcttcatttgggctctgaaatagtattacttgtgtcccaaactcataagaccttcaatgaacagcagtcccttcatctatgatggttctccatgaaggaccagacccagtccctcaggccattgggtaaataaacatgctttcccttctagcttctccttctcattttcatcctgacacacttataccattgcctatgagggtatgcacacagatgcctaggctaggtgccagctacacacacagtttttctcagtgaagcccagcatgacacctgctgcataagatctaattaattagccgacataaaagaaaaacctatttttcttttgattcttaattttagcatgtgtggagttcagtgcttcttagaaaaactttctctcagaagactactcattttaatacacagcatatgtatgttccagttacgttatctacagcaaggtatattagcaaaaagtaatagctgctctggattctgaattttgatcacttgaatacttaaaatgagtcagaattcaattttggaaaattgctgatagcaaaatgttaatgaaaaatattacatcaatcacagacttccagaaatgttgtattaaagtttcccaaaggctttcatgtacagattatttaaataatacagtctttattaatgatctctttgtaattctgaatatagcactaatttattcagttgccttaccgattcaaacaagaccataaacagcatgaaaacataaaatgttgtgtcctgatctgacacaattgctttaataatgatgagaaacaggctttacgtaaatggaaagtgattattctctctaatacacaaagtcatacagaggcagaaatctaggtttgtattcttttcatagggctagagttataaattctacaagattaactacatatagactacagccccacatacacacacacacacacacacacacacacacattagatcacactatcattttaagtgctttgttaatgtataatttacatataatcacccattgtaattgtgcagttcaatgaatacaaatatatacagttgtacgtaccaccagaatcaagatatagaacaaaaaggtataatccaaaaaatttaatcatgctccgctgtagtcaacactttctactcaccttgacccctaggaatcatcaagctactttctttcacttagcataatgattctgagtttcctctatgttgctacatctatcaggagtcaattcttttttattgttatatattactccattttatggatgtaccacaatttgtttatcctttcaccagttgatggacatgagtaatttgtattttttggctatcacgaacaaagctactgtgaacagttgtgtggacatacatttgcattgcattcgagtaaaaacctagaaatggggttggtgggtcatatagtagttatgtattttaatttctaagaaactttacaaagaggctgtaatatttttaatttctaccaacaattctatttgttccatgtctttgccaacatgggatatttttaaaatcagtcattctactgagtgtacagtgctatttcatttgtaattttaatttgtatttccttaatgatgaatgatgttcagcaaattttcatttgttcattgaccattcatatgtgttctttggtgaagtgtctgttccaatcttttttttttttttgagatggagttttgctcttgttgcccaggctggagtgcaatggcacaaactcggctcaccgcaacctctgccccccaggttcaagtgattctcctgcctcagcctcctgagtagctgggattacaggcatgcagcaccatgcccggctaattttgtatctttagtagagacagggtttctccatgttggtcaggctggtcttgaactcccgacctcagctgatccgcccacctcagcctcccaaagtgctgagattataggcgtcagccattgcacccagcctgttccaatcttttatgcagtttttattgatatttttatcttttatagtgagttatatattccaaatacaagttctatattagatatattttttacaaatgttttctcccagtctgtggtttcccttttcattttcttgtgtctttatgagagcaaaattttaaattttgataaattcaaaattatcattatttttcccttatggttcatcctaagaaatctttgcctaacccaaggttgcaaaattttctggtttttttccctatgttttctttcagaatttttataattttagctataaattttttatttatttatttatttatttatttattatttttattttattttttttttttttgagacggagtcttgctctgtcacccaggctggagtgcagtggcacaatctcggctcactgcaagctccgcctcccgggttcacgccattctcctgcctcagcctcccaagtagctgggactacaggcgcctgccaccacgcccggctaattttttgtatttttagtagagatggggtttcactgtgttagccaggatggtcttgatctcctgacctcgtgatccgcctgcctcggccttataattttagctataaatttttaagttttcagcttaaatttttatagtttaggtttagctcaataatacatttcaagttaatttttacatacaacatgaggtaagggtcaatgttcagctttttcatatagatatccaatttttcttgtgaaatttaaaggactaatcctttcccactgacttaccttggcagccattttttgaaaatcagttgactgtagatgtgtagatttatttctgaactcttcattttgttccattgatccattggtccactgatgccaacaccatacaatcttcattactgtagaattagagtaaatcttgaaattaaatagtatgagatctccaaatttgctctttgttttcaaattgttttagcttgtctacttcctttacatttttatatgtactttagaataattttctgtttctacttaaaatatagtccactggagttttgataggaatcatactgaatctatagacaaatttggagagacttggtattttaaaagtatctagtcttctgatttatgagcatggtatagctccctttttttctaaaacttaacaaagttttgtagttttaagtgtgcagccattgcacatattttttgtaaactgtcaccctagatatttcaggttttcacattataattttaagcaaagtgttggaagtagcattcctagaagtagaacagattaaaggcaaaagaaaaacgttatctgaaataattctaattgagaagaaaaatggcaatataattattgaataacaaaagctatgtaaaggaattatcattgctattacattcacttttatatctgagcatacaaattagtgctttatttacagtgaataataatataaaacctacttggagaccagtaaaaaagaaaaggccctaaaccgaaaatcagcaggcctagacttgagtcatgacttgaatattgaagaagtgtatagtacaaggtaaataaaccttgacaaacattttctcccttctcattttgtgttcaactaatacttggcaaatgtttacaagagccaaacagtatgctaaatgctataaaatgggaagaatccttcacagcatatccttaagtgtcagaatgaaacctcaaatgagaaagagttatatgaaatattttggtaagataaaatgtgtattttaatgtgctattattatttattataattatggcataaaaagttcatttaggctgggcacagtggctcacgcctgtaatcccagcactttgggaggctgagacaggcggatcacctgaggtcaggagtttgagaccagcctgaccaacatggagaaactccgtctctactaaaaatacaaaaattagctgcgcatgatggcacatgcctgtaattctagctactcgggaagctgagggaggagaatcacttgaacccgagaggtggaggttgcggcgagccgagattgcgccattgcactccagcctgggcaacaagaccaagactccttctcaaaaaagagaaagaaaaaagaaaaaaattcatttgtaggtgctattactttaatacagagctcataccaaaagaagaaagtagctctgaaaaaaattaaatggattatagctagagaatcctaaaagtaatcactccatgatacactgaaaccttttctcttctattaccttctagttgtatgatacaagtagcatctaaatccatagacatggaagaaggctgacttgtttttaaaccctacaaagaaaaagaatgacttgtttttaaacccaaaaaaaaatttgaatatttatgcattttttccttccagatgaaggaagtagccttattaatttctattaataggagatgtgctgacaatttttctgttaggaacctggcaaactcacaaatatgacagatgaactcagaatttagaagtatgccaaaagactttatgcaaaggaatatagtaaaaaagaattcagtttctctggttatagattgttatccaaataaaatatttatgtattggtcactatatcatatgtattggtcaccatatcatataaattggttgaaaaatgattttctggtttttctgtgtgtattctttttttttttaggtttgattctcataaaggtttctggtgtcagttactggaagaaggtaaaacaaaatgccttggaaagagcaaaggaagaaaataccctccaatggattctgatgtaagcatagaccttaaaaatacaaactaaatcagcaaaatggtaaccaataatatcatctactttcttaaaaaactagttaaagtcaaaattcagcctttctaaaaattaaaagtgccatttcaatttcagtacaggtaggttgcttattttgatttacccacaatatattattacctgtcatgcaagaataaaggaaaacaatagaattcaacattctgaataagaacaaagagataatatcttattccaaaaagaatgatacctgcacaaaaattttagtataaatgttaactgaaaccaagacaggaagtatatccattggaaagtgaaaataggaccaagatttctatttttggccgagtgtggcggctcatgcctgtaatctcagcactttggaaggccgacgtgggtggatcacttgaggtcaggagttcgagaccagcctggccaacatgataaaaccccatctctactaaaaatacaaaaaaagattagctgggcatggtggcaggcacctgtaatcccaactactcaggaggctgaggcaggaggatcgcttgaacctgggaggtggaggtcacagtgagcccagattgcaccattgcgctccagcctgggcagcaagagtgaaactccaactcaaaaaaaaaaaaaaaaaaatcctatttttttgactgcctgagtcattctgttgtagtaagtgtgccctgggcagtaatgtaagttactgatataatatactaagttttgagctgttaatatgctaataaaatgaaagaagcaatgtatttcccaacatctaacatactagcagataatttaggctttggggaatgtagacacacactttgcagtatgtattcagcacttcctgtttattctgttcagaatggagacatggtgatcacttaatgctacagttttctccatttctataccccacatttttactttaatgcttacttgacatatattaagatttactaataatatttttatttattattagtctagttagtagtttcaatataaccatgcaagtagattttgatttgtaaattttttttagatctcagaaattaaaatatgatttgggatttttcccccacaattaatacattacattaactgagaaccctaagatggtctgaggatcctaaggtgggctaaacttattagaatactttaacaaaaccttgaggactactttttgtgccttgcctgatagatgcagggtctgtcctcaataaactcataattaaatcatatacggaagagagagagagtttctgttattttgataaacaaactgcattttcagaactccaattttctgtggctgattaaaatataccttcagagcactttgaaaacaacccttcttttcccaaaagaaattgacatacaatttctatagtatttcaagaaagtaatataaaatatatcatatgcatttatgtcaaagctatttccccgtaaatttattaaagctaaaatgtttaagagacactgcagaatatctttcttagcattttgttttactctggtctaacacagaccttattaaatttggaggtagagaaagataagaaaaacacaacttttcaggatatccttccttctcaacaaggttactgagtaatccatattgggtttatttaagggagtggctgattttgtgaaaataatgtccacaaagcaggtaagagtaaagaggtcttcacagaggtaatgaaaatacaaatgtgtaggagggattagagtgggcagtactgtcaccacaccttttgcctcttcctagtaagaaaaatgccagtacccaagactgtcagtaaaatatcatagcatgtgctaaataaatagtccatatgcttaatacaaattttaatccagatctggtatacttggtacttatttcaacgtagtcaaagtgtatgaaatgtaataaacaaaataaaatgtacttttctctcctcctctccacttagagcaggacatttctgtcaagctactatcgagatcacaacgtggaactctcaaagctgctgcacaaactgggtcagcctctgccatcctggctgagacaggagctgcagaaagtaagatagcactgagagaaaacttgagacttcatcgtccatgtagaacacaccttttccaaagcttccagaagctaccaaaaggcagttgaaaaatatacctcttcaaatgagaaaaaagaacagtttcttccatgtgctggcacgtggatgattagaaaaaaagaaaaagtatgtgttacaagccttgaggcctgtggcctttctcttaacccatatctgagcctgtgggattattgtagactactgtgcactcatgtggaagtcaattgcaaccaacataaatatcaaacacaaatgcagaactgttccatttcatagtaatatttacacttttatatatcaactaagattgtgtctctgtaggtttttagaccactgtttgcctgtacgatgttttcttattattttattctataaagtgtcctatgaaacaagaagcaaaataaacatcacaatgtagcataaaatgtcaaaagcataacacccatgaaaaatgcttgccaaaatttaaatccacttaagtatttagaaataattgtaaattataatttgtgctagatcagagtggaaaagttatatatgagtgttatctgcaccaaaaaaaaataagtgctatagcaaaagtgattttttcatatacatagtctagtgaatatatgtaaaaattactaactcttccatcacaacgtaattgttatactgaaatatatactgtaaagctgttggatggtaaatagaaacacatcaagtacaccaaaacagtaaataacaatgtaaagtgtactgactgaatcctctaaaagggagaaattgtaggggtctaaaaacatatcatcgagaattctatgtccacttgctgtaagctgtgaatctatcccagtagtcctcactagttctacagaaatgcatgcctagagtctgaggtatgtgtcatctccagaaacaggttgacttttaaatgtgaatagctatttttaatgctccccaaaacaaaacctattaaactaaaactaaaaacagtttccctagatgatgtggttaggctatttacatttaggttattaaaaaattgcattttcccagatagttcaaaataaaattatgtaatgtagtagagatttataacaaaaaacaaattaatatattatttgtaatctaatgtttgcaatgatacttttgatataaggcaaagaaacataagcagagcagaggcccatttttgaaaatatttcacccatcactctggtggaagtaacagatcataggtacaattaaggattagctactaaattaaatgcaggaagtacaaagatgagcaagtcatgctcttgaaatatatttacatttcaattgtaaataatatatatggttaataaagtttccaaaaaagaaaagaatacatcatacttattttcctgttaatatttacttaatttttttttttgagagggggacagagtctcactatgtcacccaggctggagtgcaatggtgtgatctcagctcactgcaacctccgcctcctgggttcaagtgattctcctgcctcagcctcctgaggagctgggattacagccatgcaccaccacgcccgggtaatttttgtatttttagtagtgacagggtttcaccatgttgactaggctgatcttgaactcctgacctcatgatccacccaccttggcctctcaaagtgctgagattacaagcgtgagccaccatgccctgactacttaatttttaaatgtactgtacatatacataaaatttaagtagtaaattaattccctgctatgattataagcctttataaaatattatcaaaggtatgattagaaacaaatgggaggaaaacccatagtaaaaatattttcattgtcattttaatgggtaaaactatcaattactaattagaaaatgaattgtgagatccacttactataaatttttaactgtacattataattacttttttaaagtttcatgtacctaaagcatatgctaatttttaaatatactattagcagaaaaaattggaaaaatcaccaatttttaagactcttgactctaaaagcaaaatcaaagtgatttggacaaatatgggaaacacagtcttcatgcttactgctgtctcttttatagcagcagatgccagacatgctaggaaaattactatagtcttccatctccaccaacttaagaaaactggcttaggaaggttaaacatgagaataggcctcagcagttatatacagtgtcatgttttcatttggcaacaacatttattctaataaaaaaagaaaagaaaaactgatacatttatgctttaatggtaagatgtacatttgaactgctaagcaaagctgctaatggcctattttgtttaggtaaatcgagttgactgaacacttcatccttttaaatagatgtcaaaaacatactccgtgtttgtataaagacaggagaaaaaggaagagatcttaccaaaatttattcattcacaagtacatgtattacgctagctagagcagcaaacctgtgaaaggatttttgaccactcaatgtgtcttgaagacagcatcaaattctagaggacatgcatactttccacattatatactccaactggttaatatgctaatctgaaagtaacataaatacatatgagagaataatgagagataatctgatttaaaactagctttgtatagaattccctttttcattgtttaaaatatgaaacttcctcaggaagaaatgaaatggttatttcaatgtttatagctgtaatattcttgtcattcacattgaatgaaaattactggaaacatttttttctctgagttttttaaaataaaaaacctagatataattctgatagtagcatggtacctcatatgtacaacaataaactgataggaaaatgaa

SEQ ID NO: 985 - DNA, 80464 bp, Homo sapiens
ctactgttaaataatttctctttataaacatagtgacaacaagattgtacagtatcaattaaaaagacccaatgtgaccaggtccactgcttcctgcatcttgaagtaagacaagtgttcagcttagagatgagcacctttctttccagagggagaagacatgatgggagaaaaaaatgttctctctgagaatttacccagataaagagctgggtagtcggatctaaatggtcccacagcaatccttttctcgggggaggtgcgtagatctttgacaagtgatgaacgaactttgcttcgtgtggttaggcctgggactgaactttgtaaccagggatttggtgcgcggggcttcacaggctgcagagaaacatgaaaacatgagtgcatatgccaaacgtgtctcatgtgagcggcagagcccaagtgaaggcctctttggctatagggtgtctcctttttttttttctttttgagacggagtcccactctgtcgcccaggctggagttcagtggcgcaatctcggcttactgcaatctccgactcccgggttcaagtgattctcttgcctcagcctctgaagcagctgggattacaggcgcccgccaccacgcccagctaatttttttgtttgtttgtttgttttttttgagacggagtctcacactctctcccaggctggagtgcagtggcgccatctcggctcactgccagctccgcctcccgggttcacgccattctcctgcctcagcctcccgagtagctgggactacaggcgcccaccaccacgcccagctaattttttgtatttttagtagagacgaggtttcaccgtgttagccaggagggtctcaatctcctgaccttgtgaccagcccgcctcggcctcccaaagtgctgggattacggtgtcagccactgcgcccggcgtttttttttctttctttctttctttcttttttttttttttttgagacggagtttcgctcttgttgcccaggctggggtgcaatggtgcgatctcggctcaccgcaacctctgcccccagagttcaagggattctcctgcctcagcctcccaagtagctgggattacaggcatgcgccaccacaccctactaattttgtatttttagtagagacagcgtttctccatgttggccaggctggtctcgaactcaggtgatccgccggcctcggcctcccaaagtgctgggattacaggcatgagcctccgctcccggccacgcccagctaatttttttgtatttttagtagagacagggtttcaccatgttggccaggctggtcttgaactcctgacctcatgatctgcctgcctcagcctcccaaagtgctgagattacaggcgtgagccaccatgcccagagattattctttaattaatctcaaaagcctaacaccagggtagtctctctcagcctactctggcttgaaaagctgcccattaaaaaataaaaataaaagcctaacaccagagttcgatatatgttcactcacacatttgtagaaggaacacaatatctcttataatattctttacttcactaataagttataatttcagctatacattatatggcgttattactagttaagtaataaaaccaatgtattatttatcttgtttttcatttcttaaaaaatgaataattggctgggcacggtggctcacacctgtgatcccagcactttgggaggccaaggcaggcagctcacttgaggtcgggagttcaagaccagcctggccaacatggtgaaaccccatctctactaaaaatacaaaaattagccaggcatggcgcagatgcctgtaatctcagctactcgggaggctgaggcagaagaatcgcttgaaccaggaggcagaggttgcagtgagccaagattgcgccactgtactctagcctgggcgacagagagagactttgtctcaaaataaaaaaagattaatcaattataatggaccatattattttaattttaattttcaagatttattcttatatttgttatatttatttttaatattttattatgttttttgaatattgtatgtgaaataaaaaatgaagtcatgatacaaagtaagtctgacctgtacatgaatgtttgtagaagctttattataatcacccaaaactagaagcaaccaagatgtctttcaagaagtgaatgaacaaactggtgcacctacacaatggaagagtattcagaggtaaaaagaaacgatgcctggcgcggtggctcatacttgtaatctcagcactttgggaggccaaggcaggcggatcacaaggtcaggagttcgagaccagcctgactaacatggtgaaaccctgtctcttgtaaaaatacaaaaattacctgggcgtggtggcatgtgcctgtatttccactacttaggaggctgaggcagaagaatcgattgaacccgggggtcagaggttgcagtgagccgagaacacaccactgcactccagcctgggcagcagagcaagactccatctcaaaaaaaaaagaaagaaagaaagaaagaaatgagctgtgaagccagaaaaagacatgcattattttaattattttagtagagacagaactagtagagttaattattttagtagagacatgaacctcttcaaatgtgtattgctgccaggaggttggctgacgcctgtaatcccagcaatttgggaggccgaggcaggcagatcacttgaggtcaggagtttgagaccagcttggccaacatggtgaaaccccatctttactaaaaatacaaaaattagcggggggtggcggtgcacgcctgtaatcccagctacttgggaggctgaggcacgagaatcacttgaacccgggagtgagatattgcagtgaggtgagatggtgccactgcacttcaacctgggcaacaaagtgagactgtgtctcaaagaaaaaaaaagatatgtattgctaggtgaaagaaggcagccggaaaaggcaacatactgtataattccaattatatgacattgtgtaaaagacaaagctatagagatagtaaaaaaaggccgggcatggtggctcatgcctgtaatcccaagcactttgggaggccgacgcgggcggatcacgaggtcaggagatcgagaccatcctggctaacaaggtgaaaccccgtctctactaaaaatacaaaaaaaaaattagccgggcatggtggcgggcacctgtagtcccagctactcgggaggctgaggcaggagaatggcgtgaacctgggaggcggagcttgcagtgagccaagatcgtgccactgcactccagcctgggtgacagagcgagactccatctcaaaaaaaaataaaaaaataaaaacatcagtagttgtccagctactcgggaggctgaggtgggaggatcacttgagcaggggcagttgaggctgcagtgagccatgatcataccactgcaactccagcttaggcaacaggaggagaccctgtctcaaaataaaaaacaaaaacaaaacaaaaaaaggagaggaaaaaagaaaaatcagtggttgacaggtatttgtggggaggaaaggagggttgaataagtgaagcacaggccgggcacactggctcacgcctgtaatcccagcactttaggaggcccacgcaggcagatgacttgaggccaagagtttgagaccagcctggccaacatggtgaaacccagtctctactaaaaatacaaaaattaggccgggcacagtggctcacacctgtaaccccagcactttggaagcctgaggcgggcagatcacctgaggtcagaagttcaagaccagcctggccaatgtggtgaaactctgtctctactaaaaattcaaaaattaaccaggcatggtggcaggcgattgtaatcctagctactcaggaggctgaggcaggagaattacttgaacccagaaggcggaggctgcaatgggccgagactgcgccactgcactccagtctgggcgacacagccagacttcgagactccatctcaaacaaaaaaagggaagcacaggagactttttaaggtggtgaaactattctgaatattctgtataatatatgatggttacatgacattattcatttgttaaaacctgtagaactttacagcaagaagagtgaaccttattttttgagacagagtttcactcttgtcacccaggctggagtgcaatggtgcaatctcggctcaccataacctccgccttccaaattcaagcttcttttaaatgcctcagccacccaagtagctgagattacaggcacacaccaccatgcccagttagtttttgtatttttagtagagatgggggtttcaccatgttggccaggctggtctggaactcctggccctcaggtgatccacccatctcagcctcccaaagtgctgggattgcaggcatgaggcaccccacccagccagagtaaacgttaatgtatgcaaattaaaacaaaaacatttaggaagtaaggggatctaggaaggaatacggactgcatgtagcaagagaaccaaatgtatagagcaacttcagtgaagggagtaggaaaaacttcggaaatgtgtggaatctataagactaaatacaacaggaattgcacatagcactgtactctagttaataaaattgtttcccaggggagtgtgggttaatatttctgatttatgtatggaaaattggaacatgaagtatactaataataattgtaatgattacctgaaagaaatatagacagtcttctagtcatggagaataaattttaaaaccttcattttttacatcaggtgttttttatttgtttgtttgttttttagagacctggtcttactatgttgccccagctgccagagtgcaggagctagtacctattcacaggcacgatcatagctcactataaacttgaactcctgggctcaagtgatcctcctgtctctggcctcacatgtagctaaaactacgtgtaccatcatgccccaaccctcaatttaaatacagatttttgttgcagatgtgatgatgaaaaataaatactttcaagcacaattgtatattaggataaaattctgtgtggaagttacttcataaaggaaatgtgagcgtttttttttaagatgtaattttaattttaaagaagagcttacatattttatttttaaaatggatgatggtagttatcaaactgttatggcatttagattcaaatggatgcatttaaattcagttttgaacttaaaatatcaatatgtaaagctggaatacttacatgtttgaaattaaactctgcttctatttaaaatgaaaacattttagatgtcaattttttttttttgagacggagtctcatctctgtcacccaggctgtagtacagtggctcaatctcaggctcactgcaacctccgcctctcaggttcaagcgattatcctgtctcagcctcccgagtagctgggattacaggcatgcaccaccatacctggctaatttttctttattttcagtagagacggggttttaccatgttggccaggctggtctcaaactcccgacctcaggtgatccacttgcctctgcctcccaaagtgctgggattgcaggcgtgagccatcatgcctggcctcattttagatgtcaatttaagaaggtaaagaggtgacatcatttttcaaaattattttataggttatatgagcaagcaaaagagttggaaattcaacatcctagatagcatctgttacgacgtatagcaagactcagccaatttgttctgtaaaaggccagatagtagatatttcaggcttttggggccagatggcctattcaaactgtggttttttgtttgtttgtttgtttgtcattgagagggagtcttgccctgttgcccaggctggagtgcagtggcgcgatcctggctcactgcaacctctgtctcccgcattcaagcaattctggtgcctcagccacctgagtagctgggattataggcacatgccaccacacccggctaatttttgtattttttagtagagacggggtttcactatgttggccaggctggtctcgaactcctggccccaagtgatcctcccgcctcagcctcccaaagtgctgggattacaggcatgagccaccacacccagcctaaactttatattaacatcctaaagttaaacatgaaaattcttctataacaaataatcccattgcccagagggaacttctttctgtcttcagtttggtttatatctttccagatattcaactatgcaggcagacacacacacacacacacacagacacacacacacacacacacacacacacatatatggttttaaataaattttacataatgtaggctcatgcctgtaatcccagcactttggaaggctgaggcaggtggatcacctgaggtcagcagtttgagaccagcttagccaatatggtgaaaccttgtcactactaaaaatagaaaaattggctgggcatggtggcaagcgcctgtaatcccaactacttgggaggctgaagcaggagaatcgcttgaacctgggaggtggaggatgcagtgagccgagattgcaccactgcactccagcctgggtgacagagggaaactctgtctcaaaaaagaaaaaagaataaagaaaagaaaagaaaattatatataatgtatattggctgcattttttaagcaaaaaatgggacaacatattgttctataatttgattttttaacacgttatagacatttccttgtcattcctttaaataactattgattggtagatatttgagtaatttccagttttgaaattaaaagcaacaaccatctatgtgtaaatatctttgtacacatgggtgaattttttttttttttttcgagacagggtttggctctattgcccaggctggagtgcagtggcgccatctcagctcactgcaacctctgcatcccaggctcaagccatcctcccaccttagcctccctagtagctgggaccacaggtgtacatcaccatgcctggctaatttttgtatttaaaatttttcggcttggcatggcagctcattcctgtaatcccagcactttgggaggccaaggcagttggatcacttagggcaaggagttcaagaccagcctggccaacatggcaaaactccatctcaactaaaaatacaaaaattagttgggcatcgtggcacatgcctgtaatccaagctactcaggtgaggcacaagaatcgcttgaacctggcaggtggaggttgcagtgagccaagatcacgccactgcatttcaggctaggtgacaaagcaagactctgtctcaaaaaaaaaaaaaatgctgatttttcatagcaacagcgtctcaccatgttgctcaggctggtctggaactcttgagttcaagcaatccacctgcctcagcctaccaaagtgttgggattatcggtgttagccactgcacctggccagtgaatattttttaaggatagatttctagatgtagaattactactgggtcaaagatatcaaaattttgtattgatgaattgtcatctaaaagtttttaccagggtttctcaatcctggtactattgacatttgggcccagatactccttggttatggggtttcattgtacattgtagaatgttttacagcatccctcaatgctagtagcacccccactgttggacaaccaaaaatatctctagatattgctaaatgacccctgggggtgcaaaatagccccaggttcagaaccactgcctcggacatttgctttcttttactttccttttatttctctttctcaccatctccctttcaacaactcatgctatccttccttcttaaagaaaagaacttatgaggctgggtgtggtggctcacgcccgtaattccagcactttgggagactgaggcaggtggcttgcctgagtccaggagttcaagaccagcttgaccaacatggcgaaaccccgtctctagtgaaaatacaaaaattagccgggtgtggtggcctgcgcctgtaatcccagctacttgggaggtggagacaggagaattgcttgaacccaggaggcggagattgcagtgagccgagatcgtgccattgcactccagcctgggcaacagagtgagactctgtcttgaaaaaaaaaaagaaaggaacttataatttagtatatatcacccttccttcccagtatatttacactttagatatagatgaagtgaaagtgacaatgactaattcaagaataactatctaatgatgggatgaattttgatgggagagataatttggggtactttcctgataggctttaaatcatactatgtacacttaaacatcctgttggctctattcatcttcttttctgtagaagtttctctgaataacaatgattagcatctatattcagaatgtcaagttcctggcccagcgcgatggctcacgcctgtaatcccagcactttgggaggccaaggcgggcagatcatgaggtcaggagatggagaccatcctggctaacatggtgaaaccccgtctgtactaaaaataataataataataattaaaaaaagaatgtcaatttcctttgatttttttaaaagggaattctattgattcaaaacaaaaaaaaaaagaagagaaaggtaagcaatgcttaaaaatcaagaaaaatgagatgaattagggaaagtaaagtttattgtttaaaaaatactatattttggctgggcacagtggctcgcgcctgtaatcccagcactttgggaggctgaggcaggcagatcacctgaggtcaggagtttgagaccagcctggccaacatgggaaaccccatctctactaaaaatacaaaaattagttgggcatggtagggggtgcctgtaatcccagctactcgggaggctgaggcaggagaaaattgcttgaatctgggaggcagaggttgtagtgggccaagatagcaccactgcactccagcctggatgacagagcaagactctatctcaaaacaaacaaacaaacaaagcctatatttttagcagggcatggtggctcatgcttgtaatcccagggcagtgtgctaaatgcaagacgggatagaaaaaggcataaggaagtcttttccttgaattttaggaaggaatgtgacaagaacatgaattaccagcacaatgtgttaaattcatgtgaaagagtcaaaattctcttgagatgaaggagatggtagcgcctttggagaggagatggaatgtgaaatgggctttaattagggttttgacaaaagataattgggggacaatatgcagaggaaacagcctgagaaaacatataaaggatgatataggtaagcaacagcaaacagtctagcttgtagaagtagagtttacaggggttggggatgataggctgtaacattatgtgactccagtacctagctgaggaacttggatttgtcaatggggcacctaggtagattttgagtagggtgatgacaggtttggggcctcaacttgagaaaattcatcttgtagctatctgtggtataaattggcatgggggctgataaggtttggctctgtgtccccacccaaatctcatgttgaattgtaatctccaatgttagatgagggacctggtgggaggtgattagatcatgggggcagatttcccccttgctgctctcatgatggtggttgagttctcacaagatctggttgcttttgtttgagacggagtctcgctgtgtcgcccaggctggagtgcagtagcgtgatcttgactcactgcgacctccacttcccgggttcatgcaattctcctgcctcagcctccagagtagctgggatgacaggggcgtgccactatgcccggctaattttttgtatttttagtagagatggggtttcactgtgctagccaggatggtcttgatctcctgacctcatgatccacccaccttggcctcctgaagtgctgggattacaggcatgagcttgcttccccttcaccttccaccatgattttaagtttctttaggcctccccaaccatgcttcctctacagcctgaggaactgtgagccaattaaacctcttttctttataaattactcagtctcaggtagttctttatagcaatgtgagaatggctaatacaggagcaattaatggtaaagagacagtcgggcaccgcggctcatgcctgtaatcccagcactttgggaggccgagataggtggatcacctgaggtcaggaattcgagaccagcctgaccaacatggtgaaaccctgtctctactaaaaatacaaaaattagcttcggtggtagcaggtgcctgtaatcccagctacctgggaggctgaggcaggagaatcgcttgaacctgggaggtggaggttgcagtgagccaagattgggccattgcaacacagaggttggggtaacacagcaagaccctgtctcaaaaaaataaaataaaaataaaaaataaaggtaaagagactagttgggaggctatttgtaataaaccaggatttgtctgcctcaacactacactactgacattttgcatcagacaattatttgttgtgggagggttgtccttagtattgtagaatgtttagtagtgtctctagtgtctgtttactagatgttagacaacccctagccccctatatgacattgccaaatgtccctatggagacaatatcacccccagttgataactgtgtgtgtaacagaccatgtgagaaataaaaaagggtggatgttagacatgggtaaggacaaaatctaaaagccttggcaagtgtttggataggcttgcaactgagaaagagggagtgttgaaagctcaaacagagaaaggtcctagaggccatgtactgtagtctaatatgcttatcattgcttgaaacattgtaaaccctcttggaaggcagtttggtaaaacctattaataatcacaaaaagtatcttactttttgacccagcacttttatttctgggagtttatcttaaatgattcaaatgaagacaaggaatctttatgtacaaagcaattagttgcatgacagacagtgaccacgttctcaaaaattacacccgcatgccaccacattgcctgttaaattagaagccgatttaagatcctgagtttaagagccaaagaagttgtagctaaagaaacaaaatcccagaggggcaggaagggcagatatcaagaatgcaagtagagaaattcttaacttatttttcagagagaggacaatgaatttgagaatttgtattggagaaaagagggagagaagttaggtggaggaactcctagataaggcttcaatcagtgaattcatctgcagagcagaagtttctgcggaactcaaactgcctgggggcattccttgaaaagaagaattctgcactttttggtgggaacctgccggtggaacatcctgtttagaaatgaggacatccaaggaacactgcaatgtgcagagactagaaggaaaaaacagtcaagtagccatttctcctggggagtctctagtaacttgattttgtgcttcttcttgttttttgagacaagagtctcactctgtcgcccaggctggagtgcaatggtacgatctcggctcactgcaacctccacctcccgagttcaagcaattctcctgtctcagcctcccgagtagctgggactacaggtgcaagtcaccacacctggctaatttttgtaatttttaaattattatttatttttatttttttgaggcggagtctcgctctgtcgcccaggctggagtgcagtggcgccatctcggctcactgcaagctctgcctcccgggttcacgccatcctcctgcctcagcctcccgagtagccgggactacaggcgcccagcaccacgtccggctagttttttgtatttttcttttttagtagagacggggtttcaccgtgttagccaggatggtctcgatctcctgacctcgtgatccgcccgcctcggcctcccaaagtgctgggattacaggcggagccaccgcgcccggccaatttttgtagttttagtacagacggggtttcaccatactggtcaggctggtctcgaactcctgacctcaggtgatccacacacctcggcctccgaaagtgctaggattacagtcgtgaaccaccgcgcttggccgcaacttgatttttaaattgctctctgagtgtagattccttgtttgtttggcaagggttcttgccgctgccgctacagcttgaagccaaacatttaatgaaagagagcgggaggggccgaatagaagaatgatgggcgtggccaaccccgaggtggctggaggccgcgcccccttcccagagtgcaccgcagccgctgcattcaggaaccgctttagcttcgcccccggccggccgggcggggaagactggtgtggtctggccatggatgggctccaggccagtgcagggccgttgaggcgcgggcggccgaagcgccggcgcaagccccagccacacagcgggtcggtcctggccctgcccttgaggtccaggaagatacgaaagcagctgcgaagtgttgtatcccgcatggcagcgctgaggacgcagacgctgcctagcgagaactcggaggaatcgagggtggagtcgacggccgacgacctgggggacgcgctacccggtggggcggcggtggcggcgtcccggacgcagcccggcgagagccatacggccacctggggcccgcagagctgctggaggcctcgcccgccgcgcgctccctgcagaccccgtcggcgcgcctggtgcccgcttccgcgccgcccgcgcgcctggtggaggtgcccgccgcgccggtccgggtggtggagacctcggccctgctgtgcaccgcgcaacacttagcggccgtccagtcgtccggggcccctgcgacggcgtcggggccgcaggtggataacacgggtggggagccggcctgggactccccgctgcggcgcgtcttggccgagctgaaccgcatccccagcagccggcggcgagcggcccgcctctttgagtggctcatcgcgcccatgccgccagatcacttttaccggcgcctatgggagcgcgaggcggtgctggtgcggcggcaggaccacacctactaccagggacttttctctaccgctgacctggattcgatgctgcgcaacgaggaggtgcagttcggccagcatttggacgccgctcgctacatcaacggacgacgcgagaccctgaacccacccggccgcgcgctgcccgccgccgcgtggtccctgtaccaggccggctgctccctgcgtctcctctgtccgcaggctttctctactactgtgtggcagtttttggctgtgcttcaagagcagtttggaagcatggcaggctccaacgtttacctcacgccccctaactcgcagggctttgccccccactacgacgacatcgaggccttcgtgctgcagctggaaggtaggaaactctggcgtgtataccgaccccgagtcccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatgtttccctttcctaaggctagattattatgtgggatggttcgaagaaatgcaggagcgggaggaagatagggaaaatctataatggctgaagtgaaaagcaacctggggtggttgtagcatgtaaaaggagcatgttaatcaacctcttaaggaagagactctcaggctgggtgcggtactcatgcctgtaatcctagcactttaggaggccgaggcgggtggatcacctgaggtcagcagtttgagaccagcctggccaacatggcaaaaccccatctctagtgagaatacaaaaattagccaggcatagtggtgcgtgcctgtaatcccagctactaggggggctgaggcaggaggatcacttgaacctgggaggtggaggttgcagtgagctgagatcatgccactgcattccagcctgggcaacagagcgagactccgtctcaaaaacaaaaacaaaaacaaaaaagaatcttatctgattgggaccagttcactaactttggggataatttatgctatttaattatgcaacccaattctagtagaaaaattattttctaccagcttgttcagttttaagatcatggtatgtttttgctcactgtttgcttacatccatggctggcactgctgtcataagggcagcatgtcacctagttgtgccttcatagaccttaggcaaccaacttttagcaagctggccatgaaggaaggctactgttcaagttactttccactctcatttttattctggcagttcgaagaaacttccccaaatctgacaagtgaatattctcatggttggtggaaaagtgcctgatgtaccagaaagagcactggacttggaaccagaagacctgggtttggggtggtagctggtaggcagctggctgagtgacctgaggctgatgctacgctcaggcacacagattttgtaagtatattttggtacagtttgatttctgcaccctcatcatttaggttgcgtctgggactcttaagagtctgtcaccataatggatagttttctgttatttaaggttgagaactttacaaattctttttaaaaaagttacaaaagcatagacatacactaagtaaaaatgatagttctccctccaaccccactttccagagacaagcactattttttgtttgtttgtttttttgtttgagacagggtcccactttgttgcccaggctggggtacagtggtgagatattgggttactgcagcctcaacctcctgggctcaagcaatcctcccatctcagcctccttagtagataggactaccagtgtgtgccaccacacccagataatttttatttatttatttttttgtagagatggaggggtcttgctatgttgcccagactggttttgaactcctggcctggggtgatcctcccaccatggcctcccaaagcactgagagtccaggtgtgcgccaccacgcccaaccaccaaccactaccactattaaggttaagctcataaagcttttttgagtgcttagtcaaacatacatggtagtattgttttataaagacttgtgtttttctgatatgtccttttttgacctaacttttaagtcagttcaaatagagataacttttttttaagggagaaaataaatgaataaaaacccgagaaacaaacaaacaaaaaaaaaacacaaagactgagtggatggtagccaagagggaagagagtaccctttcctgactctttcatcctctaaggcttgctactaagtcccaaaacatccagatcctggaagaggcttattaaaggaatcaaggcatggaactcacccctaggaaacctaccctgaaaagtttcttggagtaaagtctggagtgttagtggtccttgttctcctttgggtttcaagtaaacacgttttgcttcctccctcacttttcccatgaccatctccagcttgagtattttgtgtgtcagcaagtccttttggcttagtgttttaatctaaattagaacaaataatgtttgaaaaacaaaacaaaacacctgtactaggcagcaaattatcaaaaaacattaataaagtgattgtaggaggctgaggagggaggatcacttgagcccaacagttcaaggctacagtgagctgtgatcatgccactgcactccagcctgggcaacaaagtgagaccctgtctctagaaaataaagaagtaactaattgcatatgcttatcagtagtaggtggtacataagtgcctgagaacattgttctcttatgatattggttggagattttttatacctgttcgtgaaaattttacttcagctttttgggcatgatgaacctgctaagaattgcttgcttgatgtgaagttggtttcttgaattacctttttaaagtcctttcccctctattccttcatcttatctaacagctttgaaaaattagaacaatccaggccaggcatgatggctcatgcctgtaatcccagcactttgggaggctgaggcgggtggatcacttgaggccaggagttcaagaccagcctggccaacatagcaaaaccttgtctccactaaaaatacaaaaaaattagttgggtgtggtggcacatgcctataatcccagctattttggtggctgaggcacgagaatcacttgaacccaggaggtggaggttgcagtgagccaagatcacaccactgcactccagcctgggcgacagagcgagactgtccccccctcaaaaaaaaaagcaaaaattatgttaatcctttcagctagagattttctttggtgagaaaacccagattaggaattcagaaaaattaagaagaaaatctagggggccagctctagtcccttattccttctctatgcctatttgaaaaaaaggaaaaataaacaacttgggtttggggttgatggggagaaaataggaagggagggaaatagtatttctgaaacaatgagggttacttgataggactaataggatttttgttttgtttttgtctttactagtaggaccttgtaacccaatcttgcacagatgctttgcatcttcaaatgatgtggcatctgtgtctggggttttagaaagtacttctatggtgggaaaaagggtatgtacatgtttgaggaggacagggtctgaggaactcttgagagtcctgaattttctcttgagaacagagcttgcacttatttaccctgttcttgatctcctgaagcatttcttggtttccttcatttcctaagttgagtatcttcattgtctggtacatttctctgaaagataagaagggcttcttagattattctaccctgccctttaaaaaagtatgggggtagaaaatataggacttggaatcaggtaagaatcccaagttccaatcctaactgtgcagttttgctgagccttatatgcaaaaatggtataatgcttagcttacaggaataatgtgcagtttttgagacaatatatttgtgggttttttgtttactttttgtttttgcgagatggagtcttgctctgtttcccagagctggagtgcaatggcacgatctcgtctcggctcactgcaacctccacctcccaggttcaagcgattctcctgcctcagcctcctgagttgctgggactacaggcgcgtgccatcatgcccagctagtttttgtatttttagtagagatggggtttcaccatgttggccaggctggtctagaactcctgacctcaggtgatccacccgccttggcctcccaaagtgttggggctacaggtgtgagccactgcacccggccatgcccgtctaatttttgtatttttagtagagacaggtttcaccatgttggccaggctggtctagaactcctgacctcaggtgatccatctgcctcagcctcccaaagtgttgggattacagatgtgagccacctcatctggccaagacaatatatttgaaggtgccaataggtaccatttactgaacacctttatgacaggcgctaaacatgtcatctcattaattatcaccacaaccctataatgtagactatcacctgcatttgatacatgaaaaaaatgggctcacagagtttaaataccttacacgggctcacatagctattgcatgccagagctggaattcaaaccctggtctttttgactctaaaacttgttgtcccaataggcatttgataaatgttagttgaatatatgaataacttaaaacccatcctttttttttttgagacggagttttgctcttgttgcccaggctggagtgcaatggcaccatctcggctcaccgcaacctccacttcccaggttcaagtgattctcctgcctcagcctccctagtagctgggattacaggcatgtgccaccatgcctggctaattttgtatttttagtagagacagggtttctccattttggtcaggctggtctcaaactcccgacctcaggtgatcctcctgcctcagcctcccaaagtgctgggattacaggcgtgagtcatcacacccggccaaaacccatcctggtggggagaaaagatgcatgaactacataagcttgactttcaatctaatttaggccagtttttcagttacctacttgggtgagtggtgaatgtgcaggtgaaccagtgcttttactgccattaggtagcctggaaaggcagggacatattcaatgagcaaagatgtgagagttggcagtataaggtcatggtgggagccagaggtttagtgcttactttagaacagcatcgtggttctccaggagcagcacgtctaggaaggtgtccctgacccggtccccttgaagtttcagggctaggatgctacggcaagcttccagccgtacacctggtgactcttcatagtggatagcccagagcagaagatccgtcagctcgggacttacttgcccaatctgtcccaaagctgcagagattagagggcagcatgtcactgaagactgagcttactatattctagcatccagaaataaattgagttttgcaaacaataccttcccttttggatggtaatcaccattagaattttagggataggtcagaatgggacattacctccaaaggattcctagaagagggatgttccatcccatccttgcctgttaggatatttgcctattttgggatgaaatatagaacaaataacatggaagacctgcctagtcccagcagggtgatggggaaaggaggcacaattatttatctatgtcaaaaagagaagcaatgccaaagattctaaaaagaaactaggcagattaaggggcagggttttaggtctgtagcagtcttgaaactgatctgacttttgcagagcgtaatagttgagatctccaaggaaagcaagatgcatccagcactggatacctacttggaacttatccttaattctgttggcagggactgtcttgtcagccctttctttaacttaagtttgacatatacctagactcaggatctttcactaaaaattgaagaaaattatctttctcttttcagacaaggaacttctgaaaagctaagatcattacctctcctgcacttcaccccattagagagtttcaggggatcatttctacttgcataggcaaaggtatttaaggttgaagagtttggggcactacttctataatacctcgaatggcaaaggccttgattttccagtaaggatctctctgcatcaggttcaggaggcattcaagcacctgggatggaaaaggcagtgttgagtggggaggaccagagcaagaatgaaccagaaacagctgggtgcggtggtgcacccctgtaatcccagcattttgggatgccaaggtgggcggatcacttgacatcaggagtttgagaccagcctggccaacatggtgaaaccctgtctctactaaaaatacaaaaattagccgggcatggtgtcacacgcctgtaatcccagctactcggaggctgaggtaggagaattgcttggacctgggaggcggaggttgtagtgagctgagatcgtgccactgtactccagcctgggtgacagagcgagtctccatctcaaaaaagcaaaaaaacaaaacaaagcaaaagaatgaatcagaaacagggaaaccacttatctctaaaaggagctataattgaaaaatgacctatcaattctggtgacaaatgagctggagcctaaagtaccaacctatatgcatagtgagtacattagctgaattatctgctattgattttctcagtctacagatctggggccatatggcttctcttgaacacttcaaacagatttttccctaataatggaattataactccatttatgggagttgatcctaaagcccatcagcacccaggtaatgagaagctagttaactgaggtgagaacaggattcaggggtgtgctctagaatcgaagtctgggctggctgggagctaaaccaagcttgtccaacatgtggcctaggacaacttggaatgcggcccaacacaaatttgtaaactttcttaaaacatgagatttatgccaggcgcggtggctcacgcctgtaatcccagcactttgggaggccgaggcgggcggatcacgaagtcaggacatcgagaccatcctggctaacacggtgaaaccccatctttactaaaaacacaaaaaaattagccaggtgtggtggcaggtgcctgtagtcccagctacacaggaggctgaggcaggagaatggcgtgaacctgggaggcggagcttgcagtgagccgagatggcgccactgcactccagcttgggtcacagagcgagactccgtctcaaaacaaacaaacaaacaaacaaaaaaaccatgagaattatgcacggaccttttttttttttttttagctcatcaactatcgttagtgttagtgtactttatatgtggcccaagacaattcttccattgtggcccagggaagccaaaagattggatgcccctgaaacagtcctgtttgaagtggcttatacacccccttcccagttccaatctctcattctgtgtccccacagaatgttgagcatactgtgcacaaccagggaaggtaatgccctcttcaggtcaatcaggtaagatgagaatatgtttccctgactcaccatcttgtcgcggatctgcagggcaccagctgccaaacaggctgcccgccgaactgctgtgaagtcatcagagaagcagtgcaggaagcttgggagaagcttggcggtcataagcttgagctcacctatcaggtagagagcttccacacgctcctgggaatttccttgacctagcttgaccctgtaaggcacaagttgctttcctttcacctccttaaactttcagtacctaacccccaacccccactaatgccctcatgataaaatccgggttctgtaggctgtcaatcccattcagccttatgctcatgagataagttttactgggtacagagctcgattgtcttctttacttgaatccctaatacatagctgttcagtaattaggtaatgcagggctttcagttacactgaatgactgaataaaggaaaatgtcaacttgcacctcttttcacagtcaagttctcttctccattgccctcacgtgtgccatgattatgtctgcatttggcttccagcctggaatgcctatgcagtctttttgtttgtttgtttaaattatttttatttattttattatttttttgagatggagtctcgctctgttgcccaggctggagtgcagtggctggatcttggcttactgcaagcgccgcctcctgggttcacgccattctcctgcctcagcctcctgagtagttgggactataggcgcccaccaccacgcctggctaattttgtttttcttgtatttttagtagagatggggtttcactatgttagccaggatggtcttgatctcctgacctcgtgatctgcccgcctcggcctcccaaagtgctgggattacaggcatgagccaccgcgcccggccttaaattatttttagagatggggtcttgctatgttgcccaggctggtcttgaactcctgacctcaagtgattctcctgcctcagcctgagtagctgggattataggcacttacccactctgcggctcctatgcagtctctctctcttttttttttttttttttttttgagatagggtctttctctgttgcccaggctggaatgcagtggcatgatgatggctcatgacagctttggacttcctggacccaggcagtcctcttgcctcagcctcccaagtagctgggactacaggcatacaccaccacactggctaactttttattttattttattattattatttttgagacggagtctcactctgtcgcccaggctggagtacagtggcgtgatctccgctcactgcaagctccaactcccaggttcacgccattctcctgcctcagcctcccgaatagctgggactacaggcgcccgccaccacgcccttttgtatttttagtagagacagggtttcaccatgttagtcaggatggtctcgatctcctgaccttgtgatccacccgcctcggcctcccaaagtgctgggattacaggagtgagccactgcgcccggccaattttttttttttttttttttaatttttagtagaggcaaggtcttgctatgttgcccaggctggtctcgaactcctgggctcaattgatcctcctgcttcagagtctcaaagtattgggattacaggcgtgtgccactgggctgggcctcctgtgcagtcttatccaccctctgtgaaacttggccttactcctctagccacgctgagtattccatttttctgctccagcagttatggtatatgccatttgttctagtttttaatgatttggtatttttaattaggtgtttgtatattttgcatgtggtcatcagaattgcgtcatacttttgaacaccctccagcaccgaaaccattgcctcacacctactgggcactcaatgcttctttccctagccacattgttagtttgtagggactgttaattttttacagtgggacctggtccagggtccgtacagaggagctcaacaaatgctgggtggctggatcccaggcctcctaagcactttttttttttgagacggagtcttgctctgttgccaggctggagtgcagtggcgcgatctctgctcactgcaacctccgcctcccaggttcaagcgattctcctgtctcagcctcccgagtagctgggatgacaggcatgtgccaccacgcctggctaattttttgtatttttagtaaagacagggttttactgtgttagccaggatggtctcgatctcctgacctcgtgatccgcccaccccgtcttcccaaagtgttgggagccaccttgcccagcctgcctcctaaacacttctaagaatttagaagagtgtctcctcatgttgactgggtcttacctgattatgtcgtgcacctctttcccgaggctcatttgcccaagcgcctgtgcagctgctctcctcacttccttattccagtcattccacatcagctggatcaacttatgtttcatatcctataaataggtatgatcattaggtatcatcacttaatgaatgttaattttgtgcttggcgttgtgctgttttttcttctttttttactcatcactgtactaatgaggattgtcctgagtgttttttcccatcgcttactctcccaaagaatccagtggggcagatattactaccatttacagatgatagaatggaggctttgatcagcttgtccaaggttaacctggtgagtgctggaaccaggactcaaacccaactctcccaagctcatcctttaaactatgtagtatcagtgccaacataacttgtacctgggagacttaaaatttgaaagtgatacttgatgaagtgactagctcattgcagtttgcctgggactctcctggttttggtcctgaaagtcccatggcctggacaaaccagaacagttggtcactctataagtgcacttctctcagagaggaatgggcaaagattactacacgatgatgtgtaaatgtgcccacgctgttcttcctgctagaagtatctcccttctctactcctacctggtacttgatgtctttgtagtcttcctttaggatttacctcaaaagcatctccttcctatctcttttattaaaaattttaaaaaataaaataaaaacatctccttagtgaagtcttctttgccccttgtaagcacaggaaatccccacaacaccttatagctgcttctgttctagctatttgtaacatttactaacggaagacttatccctgcacccccaggggtagcatagtgcctagtgcgtcggatgtggtcagaaactgcatgcttactgaatgagtgaaaagactcatagacatactgcctttcttagctccagcaatctgccatgaagtcctcatcatctttacctcaacccctgctagctctgcatgtctttttactttcagttgtcaattctaagtgacaagtgccaaggaggtgaaggtacaaatgaattggaagttgttaaaatgatattgttaagatgcagattctgattgagctggcttaagatgagatttttgcatttcttttttttttttttttttgagacggagtttcactcttgttgcccaggctggagtgcaatggcacgatctcggctcactgcaacctccgcctcctgggttcaagtgactctcctgcctgagcctcctgagtagctgggattatgggcatgtgccaccaagcctggctaattttttttttttttttgagacggagcctcgctctgttgcccaggctggggcgcagtggtgcgatctcaactcactgcaacctccacctcctgggatcacgccattctcctgcctcagcctcccgaggagctgggactacaggtgcctgccaccacacccgcctaattttttttatttttagtagagacagggtttcaccgtgttagccaggatggtctcgatctcctgacctcgtgatccgccctccttggcctcccaaagtgctgggattacaggtgcgagccactgtgcccggccgatttttgcatttctaataatgctcctaggtgacgcctgtgctgctggtccaggactttagcagcagggtgctatagcacttgagacagaactaacccaagtccaaaaccttttcaggtgattactgtactgagtggccagattttgtgcttcccatatcaaaatgtcagggttacagagtggaggttgttcacttatcatgggaatggcaatgttctgggctattctggagatatccaaagttataaggaaaagatgaagtagcacataggaagaagggaaagctcccatttggacagctgaagatgattgggaaataatggcaaaaacgaagtgttgcctggaattccctctttagttctagctgagccccaccatcttcaccgacagttggtttgtttttttttttagatggagtctcgctctgtcgcccaggctggagtgcagtggcacgatcttggctcactgaaaccgccgcctcccaggtttaagcgattctcctgcctcagcctccaagtagctgggatgacaggtgtgtgccaccatgcccagctaattagagatggggttttgccatgatgaccaggctggtttcaacctcctggtctcaagtgatccacccgcctcagcctcccaaggtgctgggcttacaggcatgagccaccgtaccggaccccttcacagaactttaaccaataaatttaacccacactaatctctctctctctgaaaagttttaaaagggtaccttatatttattgcttgttcttgaatcatttgtgtatattagtcttattgttcctaccatagtgttaattttgtgaaagttgggacaatggtttttttgttttgtttttttttgttttgttttttgagacagagtctcgcactgtcgcccaggctggagtgcagtggtgcgatctcggctcactgcaacctctccctcccaggttcaagcaattcttgtgcctcagccttccaagtagctaggattacaggtgccagccaccacacctggctaatttttgtattttagtacagataggatttcactatgttggccaggctggtctgaaactcctgagctctgatccacctgccttggcctcccaaagtgctggcattacaggtgtgagccaccgtgcccggccgggactatgttttatatgtgtgtgccgaacactctgagaagcagcacagacactcatttagatgggtttttgggtagtctaagtcagtgcttctcgaatgatctttgatgaagaaccaattttggcgggggggaaatatgtcattgactgataaagtctgttgatattgaggcaatatcaaattactataaacgtttcttttttttttttttttttgagatggagtctccctctgtcacccaggctagagagcagtggtgagatcttggttcactgcaacctctgcctcctgggttcaagcgattctcctgcctcagcctcccaagtagcagggattataggcgcgtgccaccacactctgctaatttttgtatttttagtagagatggagtttcaccatgttggtcaggctggtctccaactcctgacctcgtgatccgcctgccttggcctccccaagtgctgggattacagatgtgagccaccgcacccggcctactataaacgtttctaaactcctgtcagtttttgtgctatttcattgtggatcagttaccaacagtttatggaccaccagtgcactgagaagcattggcttccagacagacatattagcatttgaagataattctgggctagaagtaagaagtagtgatgtgggaacagagatctgtttggtaagaatggaataatacatagcagcaaaaagtagaaggcctctgtagctcagcctctcttaggctttctgtcctggaggcaaagaaagaggtttaccaagcagacatttccactgatccgggagaaagcctggcaggccacaatccggttcttccattgacagctgttcagctccacagcaagcatggtgtgtatcagggtctgaggaaatggaagacttgtatggatattcacaatcacttttagagatactagaaccttgaagttacattctgaaatggcatcctgcataattaatgtcaccagtgggcttacaagagatggggcatgtttccatcacagccaactgactctgggatcataaattggggaacaaaatacaaatttaataacttaaacagaaaactgggaccttcctttcctgactttaactgtttttttttttttttttttttctgagaaggttgtcccccaggctggagtgcagtggcacaatctcggctcactgcaacctccgcctctcgggttcaagtgattctgttgcctcagcctcccaagtagctgggattacaggcgcctgccaccacgcccggttaatttttgtatttttagtagaggcggggttttaccatgttggtgccaggctggtcttgaattcctgacctcaggtgatctgcctgcctcggcctcccaaagtgctgggattacaggcgtgagccaccgtgcccggccttctgtctttaactgtttttacccctaaaatgatttttatatgcctcaagcttatgactttcacatttctattgaaagtaactaaacacaaatataggcctctgcagttttcaatggtaaacttctagcagaagcaaattctacatgtcagaactcttcttgcatatgcaaatagagaccatttgcaacctaattctcacttttctctcagctaactattgtgacttccctttgtatacacctctacacccaggtttactcatgcttattctacgtttacttatgcttgagattgtcaacccaaccggctgcattttatctaattaattaattgtgtaattaattttttgaggcagggtcttgctctgtcgctcaggctggagtacagtggtgtgatctcagctcgctgcagccccaacctgccaggctcaagtgatcctcccacctcagcctcttgagtagctaggattacaggcacataccaccatgcctgactaattttatttctttttttgtagagacagggtctcactatattgcccaggctggtcttgaaatcctggactcaagggatactcccacctcagcctcccaaagtgctgggattacaggcgtgagcgaccatgcccagcccagctgcattttattttatttgtttgagacagagtcttgctctgtcacctaggctggagtgtagtggcgtgatctcagctcactgcaaccttcacctcccaggctgaagtgattttcatgcctcagcctcccgagtagctgggactactcagtgtggtaccactgcacctgtctaatttttttatttttagtagagatgaggtttcacccatgttggccagtctggtctcgaactcctgacctcaagtgatccacctgcctcggcctcccgaagtgttgggattacaggcataagccactgccccggccccagctgcatttcagattgcttacattcactgacctcaaagacctaattgctccccaaaactgtgtctgacccggtaatggacacatactgtcttctcactcagatagctcaggaggatataagactgttcctcagtgtcctcattcttctttgtaaacagctggtggaggatcctcttaatcacagggtaagtagcagtaccttccagagccaagcactgagctgcagcccagctatccacactgttacctgccacagttgggtgaaaaagagttcagaatggtgatgtgttttccccctagagaacagcctttggattgatacccaaggctgctaccccacctgatatctcacttccttgtgccccactcagtctagaaatacaatttcttatttaaaccatattgagaagaatcatattggctgggcacggtggctaacacctgtagtcctcacattttgggaggccaaggtgggcggatcacctaaggtcaggagttcaagaccagcctggccaacatggtaaaaccccatctctactaaaaatacaaaaatcagccaggcgtggtggcatgcgcctgtaatcccagctacttgggaagccgaggcaggagaattgcttgaacccaggaggcggaggttgcagtgtgagctgagatcccaccattgcactccagcctgggcaacgagagtgaaactctgtctcaaaaaaaaaaaaaaaaaaaaaaaaaatttagtccagctaccacttggtggcagtgtacctgttttgttaaagtacctagaaagagcaaattttctttttttccttttttttagagacagggtcttgctctgtcacccaggttggagtacagtggcaccattgtggcttattgcagcttcaaccccctgggctcaagctgactctgataagcatgtatatataggtctgcctcagcctcctaggtagctgggtctacaggagcacaccaccgcacctggctaattttaaaattttttatagagatggggtcttgttatgttgcccaggctggtttagaactcctatgctcaggtgatcctgtcgccttggcctcccaaagtgctgggattacaggtgtgagcgacagtgtctggtcctaattttcaaatggtctaacataaatctaaacccaatacagcagacattgcagagcatcacagtggagaggaaaggactgggaaagctgatagtgagatgtctatcccatatttccaggtcagaagtaacagggagttactcacccttcagaagggcagtctgcatgatgttccgggcaaggggattatgtgactgtatggcatattggcatattgctgctgccatccgcacatgggcattcttgtcacaaagagcagcctctagggcaggcagtagaacctccggcaagtcctggatggtcttgtctgtgatcaaaagagccaggtaagagagtactagcccctttgcttttctcacacacagcttccttcctacagccatgtggtggccaacctcagtcccagctgcagttgcttagtgctatgtaatataattacagtttagctgagcccttcagatgggcaggattttctgctcaaggtgttaaagctcacctgtgtgctggtatgccaattcccaatcctttatcatctggcctctaaacagctatatttaagccgaagaagaatgtttccagctaggctacagtgaactacaccattagttttagtgattaaaagcaaccaatttgccccatgagcccatatatatatatatatatatatatatatatatatatatatatatatatatatatatatttatttattttatatattttttgagacggagtcttgttctgtcacctgggctggagtgcagtggtgtgatctcagctcactgcaagctccgcctcctgggttcacaccattctcctgcctcagcctcccgagtagctgggactacaggcacccagctaatttttagtattcttagtagagatgggatttcaccgtgttagccaggatggtctcgatctcctgaccttgtgatccacctgcctcagcctcccaaagtgctgggattacagacgtgtgccaccgcccccagctgagcctttatatttgtaagaacaattatatttaggtagtgctttataatatagtgtttttacattatcttgttatctttcaaccttggttgaattaggcaaggtaggtatcattgtagagctcactagggagtcttttttggttcaactaaacagtaaggttcataagactgtcatgggccatgcatggcaccagaagaatatgggacaggagcatagtttgtcaacagggcagcagcatcaggcatccctgttggctggagtttttttgtttttgtttttgttttttttttgagatagagtttttgctctgttgcccaggctggagtacaatggcacaatcttggctcactgcaacttctgcttcctgggttcaggcgattcttctgcctcagccttccgagtatctgggactacaggcacctgtcaccacgcctggctaatttttgtatttttggtagagatgaggtttcaccatgttggccaggctggtcttgaacccttgacttcaggtgatccacctgccttggccttccaaagtgctggaattacaagtgtgagccaccacacctggctttggctgcagttcttgaggctgtcttgagcattccacagagtcttggggacagcacaggagcatgttgtttattcactgggtgaatttatgctttacaggaactaatatctcttataaaaactccatagacacaattctagggtccacaaagggcctgcctgttataagttacagtatccagggaggcccaaactatggtgtccctatcaagtatttatatttcacttatagctcttctcagtcccaatgtaatttatcaaacaggatttatatcataaccaatgttgcctataaagatagttcttatcaggtgtttaggggaacaggtgggcatttaactgaagttcaaattctcaagtaggaaggggaaaggtttgttatccctttgtctaccactagtctcattttatagataggtaatttgaagctcagagaggttagctgactgcccaaggagtggcacagctaagcccgtgaatcatattttaagattttgtcaggtgcggtggctcatgcctgtaatcccagcactttgggaggctgaggtgggtggatcacttgaggtcaggagttcaagaccagcctggccaacatggtgaaaccccatctctactaaaaatacaaaaaaatgagctgggcatggtggcacacgcctgtatgtagtcccagctactcgggagactagggcaggagaattgcttgaacctgggaggtggaggttgcagtgagcagagatcgcgccactgcactccagcctgggtgacagagcaagactctgtctcaaaaataaataaataaataaataaataaataaataaataaataaataaaataaaataaaaaagaatgggctcttggctgggcacagtggctcacgcctgtaatcccagcagtttgggaggttaaggtgggaggattacttgaggccaggagttcaagactagcctggtcaacatagcaagacacagtctctaccaaaaacaaaaacaaaaaagaatgggatcttcaaggtgggaaatgttaacttctctgcaggccactgagcaaacaaaaggtgatgaaatgtagttcaaaaattactggactagaagtctggaattttaatctcgtctctattgctgataagcatgtatatataggccagtctctaagtcttggtttccacatttgtaaaatgatctcagataagccctgggtccctaccagttcagatgttccatggctttatgagttgcttatgttctcaagcagttcagctttggctctcacctgagtctctctggctggtggcaatccggggccgttccaaagcagctgtggcacatgtggtgatagctttgatccgaacgtcatcatgcaggtctcccaagctctgaagcaggttctctactgtctcatggtgccactctatgactgagccgcagtgagggaaatgaaaagagaaccacctggttagggttagatattgtgctgcaggcaggtgacaagaagtctgcccttcacccagaataattcaagcaaaacattagctcagaagaataaagggcccagagatggggtctttagggagttatttctctgatgatccatgtaccctcacaagtaagttcccagacaaaacttctcccaaccccatcgtatctatctctctttctttaaatcacttttcgttgtaaccatctgggaaataaaagtgacaataaaacaaagtagttaagagtactttgttttcagacatacctggtttgggatcacagttattagctgtgtgactgtggataagttacttaaccctgagcctgagatttcttatttgtaatacaggcataatactagaacccacatattgagttattcttactgttaaatgagttaactagacaaagtgtttagcaaaatgcctggcaagataatgaaggttcaataaatgttaactattgtggttttcattaggttctttgtctttgagggcacttccatttggctttcaacatcttcctcattttagttgctaaatactcttttggcaggtatcagacttttatttcaaagctcctattatctgtaggtgtttccttcagtcttttttgttattgtttatctgatccagtttacctaatggattgcctctctttttcctgcactaactaagcttgtctatcatgttctgaaagccagcagctattgagttctcaaataccatagctttcaacagtccttgccaggccattactttgtcccaggcactcagacttctactctcctatctttgaaggcaaagtaggtataggatagccccaactctacgaatgaattttggagaggggttgctgataccatagtcaactatgacatggacaatggttggacagcatattttgttcttcccttcatacatcatttgctgagcataaagtttggaaaacaataagatagggtcgcctgggtgcagtggcttatgcttgtaatcccagcactttgggaggccaaggcggggagatcacctgaagtcaggagttcgagaccagcctggccaacatggtgaaaccgtgtctctactaaaaacacaaaaattagccagacatcatggcacatgcctatagtcccagctacttgggaggctgaggcaggagaatcgcttgaacctgggaggtagaggttgcagtgagcccaaatcaagtgccatggcactccggcctgggcaacagagtgaaattccatctcagaaaaagaaaaaagggctggcgcggtggccaaggcgggcagatcacctgaggtcaggagtttgagaccactctggccaacatggtgaaaccccatctctaccaaagatacaaaaagttaaccaagtgtggtggcgggtgcctgtaatcctagctactcaggaggctgaggcaggagaattacttgaaaccaggaagcagaggttgcagtaagctgagatcccaccgttgcactccagccaaggcaacaagagcgaaactacgtctccaaaaaaaaaaaaaaaaaaaaaaaaaaaaatggtctctgcctctgaagagtctgcagtgtaataatgagtttccacaaattactgaagtaatacccatccatgcaaaaagcacccagatatatgttaactgaagttcatctaacacccaatgtgtgaaaggctcttgtctagccttaatgaggcaaccagatttttacatttcacaaaggagggatggatttttcaaagactgagaaagcctagtcccagatgagaaccacttctcacaaacgtacagtatcacaggacctcccttcactcactcagagcccaggcagtcttccattccttcagcatcctccgcaggaccaccagttcccaggtcacatcctcctgcagtgattttgcctgcttcttcaatctcctggtcttaataggcacatccttctcacccacctgcagcagcatatccttggcgggggtgggcaaagcagtccagcgcagggctccttgcacaggtctgtaagctgtgcaacgtggcagtgtgaggtcttttcaccccactgccttaggccctgccacacagtggccccagcttgcatcccattcctattcctgactaataccaaagcaaaacaaaaccctcaagagtgaatttccccatgattatatggggaactgagtacatgtacacagggaattatggaaagtcctgactagacatggtaagccatgatgatgatgggggtgagagatttgtggggggaaattgagatatctacaaacctttctataagtttaaaggttatctttaggaacctaaatctttaggaacataaatatgtttatatgtaacgagatttgctcataatatttgatacgttgcaatttagtgtcattggccattatttctaaagtattaagttttccttttaatgtttttaatttggggagaataatagtgctataagctgtgaaattttaaagattttaacatctctgagtttttcctcaagacaacagaaatttgagaacagaagaagccgtaaatattagatatagttagaaaagctatagttggccgggtacggtggcttttgcctgtaatcccagtactttgggaggccgaggcgagcagatcacgaggtcaggagatcgagaccatcctggctaacacggtgaaaaccccgtctctactaaaatacaaaaaattggccgggcatggtggcatgtgcttgtagtctcagctacttgagaggctgaggcaggagaatcacttgaacctgagaggcggaggttgcagtgagctgagattgcaccactgcattccagcctggacgacagagtgagactccgttctcaaaaaaaaaaaacaaaaaaaaaactatagttatattttctgaacttaatgtttttcatggtgtcaaatttagaaagcctctttctcagaaaaaaagctctatggagaaggggaagggaaaaatgataaaaacatttccagatgtactaaattcattattcacactgcctattagtctcatgttctaatcagtcactatcagccatttctgtttttttccaagatttcattctgactcttaacacctttagatttgctctgaatcaattctttcctttgagcaaggaagacataacatttctttcttctaatgtaaaaagagtcctgtgaggcggggtgcagtggctcatgcctgtaatcccagcactttgggaggccaaagcgggtggatcacttgaggtcacaagttcgagaccagcctgaccaacatggtgaaaccctgtctctactaaaaatacaaaaatttgctaggcgtggtggtgggcgcctgtaatcccagctactcgggatgctgaagcagaagaatcacttgaactggggaggcggaggttgtagtgagctgagatcgcgctccaacctgggtgacaaagcgagactccatctcaaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatcaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatctaaagctggggtccctaacccccaggccatgggcctgtaccagttcatggcctgttaggaaccgggccaccacaacaggatgtgagtggtgggtgggcaagcattaccagtgagctctgcctcctgtcagatcagcagtggcattagagtcacgtagcatgaaccttactgtgaactgcacatgtgaggggtctaggctgcgcaccctttatgataatctaatgcctgatgatctgaggtggaaccatttcatcctcaaaccatccccaccccgctggtctgtggaaaaattatcttccacgaaaccggtccctggtgccaaaaaggttgaggactgccgatctaaagggagcacacaaagtaatgactcttggcagggtacagtggctcatgcctataatcccagcactttgtttgggaggctaaggtgggaggaccccttgtggccaggagttcgagaccagtctgggcaacatagtgagaccctatctctaaaaaagttaaaaattagctgagtgtagggtgcacacctgtggccctgatcctcctgcatcagcctcgcgagtggctgggactccaggtgcgtgccaccatgcccaactaagttttgtatttttttgtagagacggggtctcaccttgttgcctagactagtctgaaactgctaggctcaagcgatctgcctgcctcatcaaattgtatggtttaacaggattaattttatagtatgtaaattcaagctcaataaagctgttattgaaaaagaatcctctggctgggagagtggctcatgcctgtagttccaacactttgggagtctgaagagggtgcatcacttgagcccagaagtttgagaccagcctgggcaacacagcaagaccttgtctttacaaaaattagctgggtatagtggtgtgcacctgtagttccagctactcgggagagtgaggtggaaggattgcttgagctcaggaaggtaaaggctgcagtgagccatgattgtaccactgtgctcagcctgggaaacagagtgagaccctgtcaaaaaaaaaaaaaaaagaagaagaaaagagagagagggaaggggaggggaagggggaagagaggaaagggagacatgaaggaaggaaagggagaaggaaaggaaggaaaaaaaggaagggaggaaggagaaaagaaaaagaggctggacacggtggctcacgcctgtaatcccagcactttgggaggccgaggtggacagatcacgaggtcaagagatcaagaccatcctggccaacatggtgaaccccgtctctactaaaaatacaaaaattagctgggtgtggtggcgcgcacctgtagtcccagctactcgtgaggcagaggcaggagaatcacttgaacccaggaggcggaggttgcagtgagccgagatcacgccaccgcactccagcctgggcgacagagcgagactttatctcaaaaacaaagccaggttgtgtggaaatcctgtggctgtccacagctgtctggcgggtgcctccacagcaggcacagaatgtgcctgtgcctccaaggatagactgagcccagggaaggacttcttgccaagtggatgcaaaggcacaactagcaggccaggcaaccctgtcagccaggtgtggaggcatgcacctgtgattccagctaccctggaggctgaggcaggggaattgcttgaaccaggaagatggaggttgcagtgagcagagatcacgccactgcactccagcctgggtgacagagcaagactctgtctccaaaaaaagaaaaaaaaaaaaaaggaatgggtgacaactgctgttagtttctgcacaccactgggcccatctgaacagtaatcctacaaagagtcatgggaaatagagtcttgtggaagatgtgcacattttgtttcataagctaatttcttggtcaccttctttccctctttgtcttacagagtgaagaatgatgaacttgtgaaagttcaggtatgggtgggctgagtgtggagtgggagggtagagccagcccaagggaaaagggcagaatgctgggtcaggagtttgatgcactttccctgttaggtgcactttccctgttagcattgagataggagctgccttattggtaactagtggccctaaaccacttggttatacctaagttatatcagatctcaagtgattgtatgttcctgtgaggctcttcctagttatagttagtattttataattttgtgagattatttttagtacgtagaaaggggattgcctagatgctaatggtgcttcagcccatgaactgggagctctagcacatgaatagtgggtaatgatgggaagtagccacattcccgttattaacccctgccttccctgttagcttcctgcttacatgcttcaggaattgcctgggcactccacttttctggagtttcagggaagaccttagatagctgcttgttgtaccgatttaggttttccaggacaatctggtctctctttgcaccaatctggtggatgatctggacttcatctgtgaacagacaaagaaacaatgagtcccctataacctccctatttcctttctccctgggttcctaatcaccaggatcagacccaacttccttttgccctaatctaagcccctaggatccatgactgccatactctggggcatcccttgaaggtgaccattgcttagaaatatcacagtgataaatcactatagtgtctgtgggggaaaaaaaaaagaaaaaggaaatgtcatagctagtcacctcattagaggcctgggagccaaggatggtgatttccttcctaaggcagaacctatggccgggtgtggtggctcacacctgtaatctcagcactttgggaggccgaggtgggtggatcacatcatcaggagttcgagaccagcctgggcaacactgtaagacccccgtctctacaaaaaatacaaaaattagctgggtacagctactcgggaggctgaggcaggagaatcagttgagcctgggaggtggaggttgcagtgaagatagcaccactgcactccagcctaggcaatgggagtgaaaccatttcaaaaataagaaaagaaccggctgggcaccatggctcacgcctgtaatcccagcactttgggaggctaaggagggcggatcacaaggtcaagagattgtgaccatcctggccaacatggtgaaaccctgtctctactagaaatacaaaaattagctgggcgtggtgatgcgcgcctataatcccagctatttgggaggtggaggcagaggttgcagtgagccaagattgtgtcactgcactccagcctggcgacagagcaagactccgtctcaatagaaaagaaaacaaaagaaaagaacctatgtaaccacttagaggccttatcccttataaaaagctagatactaaaaaagaggcacctaattaatctcatcagtcatgaatacttagagtaattttgttaaacactttgagaagactttcagctgcagcagtttaggaacaagatggggcttgggaagaagaaacagcttggaacacgaagacctagattgagtatcctggaagcccaggcatctaagggacagcagtagggacagggaaggtggcaaacatttactgaacaccttaaacagacattgagcaagaagcattacagatgctttctcatctactctactcaaagtgcatttttgttaacatcacttcacaaataaggtacttgtggctcagaggaattatataatttactgaaggttactaaaaaaatactgagccaggatttaaacccaaatgtgcctgactccaaagccctgattttttccaacatagcaccttggtgggagaatatctcgaagtgggagaatatctcgaagtgagagaagggagaagggtagatagagaagagatggattgttcccaaagtcttgccaactttacagttccacccttcattgcctctttagtaagatagagggatagagaaagcggggagagagagcagttccctccctattagttatcactccccgacccaactcctgtgctagtgtgggtgctgggtcatgaacatgaaaacctgggtcatccagggcctcttgtccatacccacaactgtttccagcccccagcaatcttccaccttcctggcccatgtccccgtgtgcccctaccacaggggcccagctctattaccaaagtaaatctcctgttcaaaggtgttgtctgtggagtaggcaaactttccagctcggggagtcacctggcgaaagtagctctgggtttggggctgggagaggctcgtcttttcatggatatcctcagtgctcttgttgccaggcatgatctcaactgtctctgcttgttggaagtaactgggcaatcttggcaggggtgagaaaggagggaaaagggggaaagagtaggaggtggatccccctttccattaaatccacagctcgttccctttcctctttaagctcagctcctatacacgtgagcattgcagaacaccaatgtttaacttttagccttgtccccatggtgccagttgaatgtggagctgccagaagggcctgtctacagctgtcctgcctggctactaaaggatccatgccttctgcagccaccaagcagcagggcagagtggcggtgctccagcataacccttttttaacattcgtactcttagaggcggcatggccttggggaagggatcccacctccttcgtcatctcactctgtctattctgtgtgtggttatttaatgtccatccacctggtggtggacaggctgtaagctccttaaaggtacatatctgtgtctgttgcttttacattgtattcccagcactttgcagagtgcctggaaagtagcaagaacataatttatatttgtccaataaatgaataaataaatggatttccactgatttttagttcactcttggaaatcagggatagtgtaatagctccagtcttccctctagctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttcc

SEQ ID NO: 986 - DNA, 80460 bp, Homo sapiens
tgttaaataatttctctttataaacatagtgacaacaagattgtacagtatcaattaaaaagacccaatgtgaccaggtccactgcttcctgcatcttgaagtaagacaagtgttcagcttagagatgagcacctttctttccagagggagaagacatgatgggagaaaaaaatgttctctctgagaatttacccagataaagagctgggtagtcggatctaaatggtcccacagcaatccttttctcgggggaggtgcgtagatctttgacaagtgatgaacgaactttgcttcgtgtggttaggcctgggactgaactttgtaaccagggatttggtgcgcggggcttcacaggctgcagagaaacatgaaaacatgagtgcatatgccaaacgtgtctcatgtgagcggcagagcccaagtgaaggcctctttggctatagggtgtctcctttttttttttctttttgagacggagtcccactctgtcgcccaggctggagttcagtggcgcaatctcggcttactgcaatctccgactcccgggttcaagtgattctcttgcctcagcctctgaagcagctgggattacaggcgcccgccaccacgcccagctaatttttttgtttgtttgtttgttttttttgagacggagtctcacactctctcccaggctggagtgcagtggcgccatctcggctcactgccagctccgcctcccgggttcacgccattctcctgcctcagcctcccgagtagctgggactacaggcgcccaccaccacgcccagctaattttttgtatttttagtagagacgaggtttcaccgtgttagccaggagggtctcaatctcctgaccttgtgaccagcccgcctcggcctcccaaagtgctgggattacggtgtcagccactgcgcccggcgtttttttttctttctttctttctttcttttttttttttttttgagacggagtttcgctcttgttgcccaggctggggtgcaatggtgcgatctcggctcaccgcaacctctgcccccagagttcaagggattctcctgcctcagcctcccaagtagctgggattacaggcatgcgccaccacaccctactaattttgtatttttagtagagacagcgtttctccatgttggccaggctggtctcgaactcaggtgatccgccggcctcggcctcccaaagtgctgggattacaggcatgagcctccgctcccggccacgcccagctaatttttttgtatttttagtagagacagggtttcaccatgttggccaggctggtcttgaactcctgacctcatgatctgcctgcctcagcctcccaaagtgctgagattacaggcgtgagccaccatgcccagagattattctttaattaatctcaaaagcctaacaccagggtagtctctctcagcctactctggcttgaaaagctgcccattaaaaaataaaaataaaagcctaacaccagagttcgatatatgttcactcacacatttgtagaaggaacacaatatctcttataatattctttacttcactaataagttataatttcagctatacattatatggcgttattactagttaagtaataaaaccaatgtattatttatcttgtttttcatttcttaaaaaatgaataattggctgggcacggtggctcacacctgtgatcccagcactttgggaggccaaggcaggcagctcacttgaggtcgggagttcaagaccagcctggccaacatggtgaaaccccatctctactaaaaatacaaaaattagccaggcatggcgcagatgcctgtaatctcagctactcgggaggctgaggcagaagaatcgcttgaaccaggaggcagaggttgcagtgagccaagattgcgccactgtactctagcctgggcgacagagagagactttgtctcaaaataaaaaaagattaatcaattataatggaccatattattttaattttaattttcaagatttattcttatatttgttatatttatttttaatattttattatgttttttgaatattgtatgtgaaataaaaaatgaagtcatgatacaaagtaagtctgacctgtacatgaatgtttgtagaagctttattataatcacccaaaactagaagcaaccaagatgtctttcaagaagtgaatgaacaaactggtgcacctacacaatggaagagtattcagaggtaaaaagaaacgatgcctggcgcggtggctcatacttgtaatctcagcactttgggaggccaaggcaggcggatcacaaggtcaggagttcgagaccagcctgactaacatggtgaaaccctgtctcttgtaaaaatacaaaaattacctgggcgtggtggcatgtgcctgtatttccactacttaggaggctgaggcagaagaatcgattgaacccgggggtcagaggttgcagtgagccgagaacacaccactgcactccagcctgggcagcagagcaagactccatctcaaaaaaaaaagaaagaaagaaagaaagaaatgagctgtgaagccagaaaaagacatgcattattttaattattttagtagagacagaactagtagagttaattattttagtagagacatgaacctcttcaaatgtgtattgctgccaggaggttggctgacgcctgtaatcccagcaatttgggaggccgaggcaggcagatcacttgaggtcaggagtttgagaccagcttggccaacatggtgaaaccccatctttactaaaaatacaaaaattagcggggggtggcggtgcacgcctgtaatcccagctacttgggaggctgaggcacgagaatcacttgaacccgggagtgagatattgcagtgaggtgagatggtgccactgcacttcaacctgggcaacaaagtgagactgtgtctcaaagaaaaaaaaagatatgtattgctaggtgaaagaaggcagccggaaaaggcaacatactgtataattccaattatatgacattgtgtaaaagacaaagctatagagatagtaaaaaaaggccgggcatggtggctcatgcctgtaatcccaagcactttgggaggccgacgcgggcggatcacgaggtcaggagatcgagaccatcctggctaacaaggtgaaaccccgtctctactaaaaatacaaaaaaaaaattagccgggcatggtggcgggcacctgtagtcccagctactcgggaggctgaggcaggagaatggcgtgaacctgggaggcggagcttgcagtgagccaagatcgtgccactgcactccagcctgggtgacagagcgagactccatctcaaaaaaaaataaaaaaataaaaacatcagtagttgtccagctactcgggaggctgaggtgggaggatcacttgagcaggggcagttgaggctgcagtgagccatgatcataccactgcaactccagcttaggcaacaggaggagaccctgtctcaaaataaaaaacaaaaacaaaacaaaaaaaggagaggaaaaaagaaaaatcagtggttgacaggtatttgtggggaggaaaggagggttgaataagtgaagcacaggccgggcacactggctcacgcctgtaatcccagcactttaggaggcccacgcaggcagatgacttgaggccaagagtttgagaccagcctggccaacatggtgaaacccagtctctactaaaaatacaaaaattaggccgggcacagtggctcacacctgtaaccccagcactttggaagcctgaggcgggcagatcacctgaggtcagaagttcaagaccagcctggccaatgtggtgaaactctgtctctactaaaaattcaaaaattaaccaggcatggtggcaggcgattgtaatcctagctactcaggaggctgaggcaggagaattacttgaacccagaaggcggaggctgcaatgggccgagactgcgccactgcactccagtctgggcgacacagccagacttcgagactccatctcaaacaaaaaaagggaagcacaggagactttttaaggtggtgaaactattctgaatattctgtataatatatgatggttacatgacattattcatttgttaaaacctgtagaactttacagcaagaagagtgaaccttattttttgagacagagtttcactcttgtcacccaggctggagtgcaatggtgcaatctcggctcaccataacctccgccttccaaattcaagcttcttttaaatgcctcagccacccaagtagctgagattacaggcacacaccaccatgcccagttagtttttgtatttttagtagagatgggggtttcaccatgttggccaggctggtctggaactcctggccctcaggtgatccacccatctcagcctcccaaagtgctgggattgcaggcatgaggcaccccacccagccagagtaaacgttaatgtatgcaaattaaaacaaaaacatttaggaagtaaggggatctaggaaggaatacggactgcatgtagcaagagaaccaaatgtatagagcaacttcagtgaagggagtaggaaaaacttcggaaatgtgtggaatctataagactaaatacaacaggaattgcacatagcactgtactctagttaataaaattgtttcccaggggagtgtgggttaatatttctgatttatgtatggaaaattggaacatgaagtatactaataataattgtaatgattacctgaaagaaatatagacagtcttctagtcatggagaataaattttaaaaccttcattttttacatcaggtgttttttatttgtttgtttgttttttagagacctggtcttactatgttgccccagctgccagagtgcaggagctagtacctattcacaggcacgatcatagctcactataaacttgaactcctgggctcaagtgatcctcctgtctctggcctcacatgtagctaaaactacgtgtaccatcatgccccaaccctcaatttaaatacagatttttgttgcagatgtgatgatgaaaaataaatactttcaagcacaattgtatattaggataaaattctgtgtggaagttacttcataaaggaaatgtgagcgtttttttttaagatgtaattttaattttaaagaagagcttacatattttatttttaaaatggatgatggtagttatcaaactgttatggcatttagattcaaatggatgcatttaaattcagttttgaacttaaaatatcaatatgtaaagctggaatacttacatgtttgaaattaaactctgcttctatttaaaatgaaaacattttagatgtcaattttttttttttgagacggagtctcatctctgtcacccaggctgtagtacagtggctcaatctcaggctcactgcaacctccgcctctcaggttcaagcgattatcctgtctcagcctcccgagtagctgggattacaggcatgcaccaccatacctggctaatttttctttattttcagtagagacggggttttaccatgttggccaggctggtctcaaactcccgacctcaggtgatccacttgcctctgcctcccaaagtgctgggattgcaggcgtgagccatcatgcctggcctcattttagatgtcaatttaagaaggtaaagaggtgacatcatttttcaaaattattttataggttatatgagcaagcaaaagagttggaaattcaacatcctagatagcatctgttacgacgtatagcaagactcagccaatttgttctgtaaaaggccagatagtagatatttcaggcttttggggccagatggcctattcaaactgtggttttttgtttgtttgtttgtttgtcattgagagggagtcttgccctgttgcccaggctggagtgcagtggcgcgatcctggctcactgcaacctctgtctcccgcattcaagcaattctggtgcctcagccacctgagtagctgggattataggcacatgccaccacacccggctaatttttgtattttttagtagagacggggtttcactatgttggccaggctggtctcgaactcctggccccaagtgatcctcccgcctcagcctcccaaagtgctgggattacaggcatgagccaccacacccagcctaaactttatattaacatcctaaagttaaacatgaaaattcttctataacaaataatcccattgcccagagggaacttctttctgtcttcagtttggtttatatctttccagatattcaactatgcaggcagacacacacacacacacacacagacacacacacacacacacacacacacacatatatggttttaaataaattttacataatgtaggctcatgcctgtaatcccagcactttggaaggctgaggcaggtggatcacctgaggtcagcagtttgagaccagcttagccaatatggtgaaaccttgtcactactaaaaatagaaaaattggctgggcatggtggcaagcgcctgtaatcccaactacttgggaggctgaagcaggagaatcgcttgaacctgggaggtggaggatgcagtgagccgagattgcaccactgcactccagcctgggtgacagagggaaactctgtctcaaaaaagaaaaaagaataaagaaaagaaaagaaaattatatataatgtatattggctgcattttttaagcaaaaaatgggacaacatattgttctataatttgattttttaacacgttatagacatttccttgtcattcctttaaataactattgattggtagatatttgagtaatttccagttttgaaattaaaagcaacaaccatctatgtgtaaatatctttgtacacatgggtgaattttttttttttttttcgagacagggtttggctctattgcccaggctggagtgcagtggcgccatctcagctcactgcaacctctgcatcccaggctcaagccatcctcccaccttagcctccctagtagctgggaccacaggtgtacatcaccatgcctggctaatttttgtatttaaaatttttcggcttggcatggcagctcattcctgtaatcccagcactttgggaggccaaggcagttggatcacttagggcaaggagttcaagaccagcctggccaacatggcaaaactccatctcaactaaaaatacaaaaattagttgggcatcgtggcacatgcctgtaatccaagctactcaggtgaggcacaagaatcgcttgaacctggcaggtggaggttgcagtgagccaagatcacgccactgcatttcaggctaggtgacaaagcaagactctgtctcaaaaaaaaaaaaaatgctgatttttcatagcaacagcgtctcaccatgttgctcaggctggtctggaactcttgagttcaagcaatccacctgcctcagcctaccaaagtgttgggattatcggtgttagccactgcacctggccagtgaatattttttaaggatagatttctagatgtagaattactactgggtcaaagatatcaaaattttgtattgatgaattgtcatctaaaagtttttaccagggtttctcaatcctggtactattgacatttgggcccagatactccttggttatggggtttcattgtacattgtagaatgttttacagcatccctcaatgctagtagcacccccactgttggacaaccaaaaatatctctagatattgctaaatgacccctgggggtgcaaaatagccccaggttcagaaccactgcctcggacatttgctttcttttactttccttttatttctctttctcaccatctccctttcaacaactcatgctatccttccttcttaaagaaaagaacttatgaggctgggtgtggtggctcacgcccgtaattccagcactttgggagactgaggcaggtggcttgcctgagtccaggagttcaagaccagcttgaccaacatggcgaaaccccgtctctagtgaaaatacaaaaattagccgggtgtggtggcctgcgcctgtaatcccagctacttgggaggtggagacaggagaattgcttgaacccaggaggcggagattgcagtgagccgagatcgtgccattgcactccagcctgggcaacagagtgagactctgtcttgaaaaaaaaaaagaaaggaacttataatttagtatatatcacccttccttcccagtatatttacactttagatatagatgaagtgaaagtgacaatgactaattcaagaataactatctaatgatgggatgaattttgatgggagagataatttggggtactttcctgataggctttaaatcatactatgtacacttaaacatcctgttggctctattcatcttcttttctgtagaagtttctctgaataacaatgattagcatctatattcagaatgtcaagttcctggcccagcgcgatggctcacgcctgtaatcccagcactttgggaggccaaggcgggcagatcatgaggtcaggagatggagaccatcctggctaacatggtgaaaccccgtctgtactaaaaataataataataataattaaaaaaagaatgtcaatttcctttgatttttttaaaagggaattctattgattcaaaacaaaaaaaaaaagaagagaaaggtaagcaatgcttaaaaatcaagaaaaatgagatgaattagggaaagtaaagtttattgtttaaaaaatactatattttggctgggcacagtggctcgcgcctgtaatcccagcactttgggaggctgaggcaggcagatcacctgaggtcaggagtttgagaccagcctggccaacatgggaaaccccatctctactaaaaatacaaaaattagttgggcatggtagggggtgcctgtaatcccagctactcgggaggctgaggcaggagaaaattgcttgaatctgggaggcagaggttgtagtgggccaagatagcaccactgcactccagcctggatgacagagcaagactctatctcaaaacaaacaaacaaacaaagcctatatttttagcagggcatggtggctcatgcttgtaatcccagggcagtgtgctaaatgcaagacgggatagaaaaaggcataaggaagtcttttccttgaattttaggaaggaatgtgacaagaacatgaattaccagcacaatgtgttaaattcatgtgaaagagtcaaaattctcttgagatgaaggagatggtagcgcctttggagaggagatggaatgtgaaatgggctttaattagggttttgacaaaagataattgggggacaatatgcagaggaaacagcctgagaaaacatataaaggatgatataggtaagcaacagcaaacagtctagcttgtagaagtagagtttacaggggttggggatgataggctgtaacattatgtgactccagtacctagctgaggaacttggatttgtcaatggggcacctaggtagattttgagtagggtgatgacaggtttggggcctcaacttgagaaaattcatcttgtagctatctgtggtataaattggcatgggggctgataaggtttggctctgtgtccccacccaaatctcatgttgaattgtaatctccaatgttagatgagggacctggtgggaggtgattagatcatgggggcagatttcccccttgctgctctcatgatggtggttgagttctcacaagatctggttgcttttgtttgagacggagtctcgctgtgtcgcccaggctggagtgcagtagcgtgatcttgactcactgcgacctccacttcccgggttcatgcaattctcctgcctcagcctccagagtagctgggatgacaggggcgtgccactatgcccggctaattttttgtatttttagtagagatggggtttcactgtgctagccaggatggtcttgatctcctgacctcatgatccacccaccttggcctcctgaagtgctgggattacaggcatgagcttgcttccccttcaccttccaccatgattttaagtttctttaggcctccccaaccatgcttcctctacagcctgaggaactgtgagccaattaaacctcttttctttataaattactcagtctcaggtagttctttatagcaatgtgagaatggctaatacaggagcaattaatggtaaagagacagtcgggcaccgcggctcatgcctgtaatcccagcactttgggaggccgagataggtggatcacctgaggtcaggaattcgagaccagcctgaccaacatggtgaaaccctgtctctactaaaaatacaaaaattagcttcggtggtagcaggtgcctgtaatcccagctacctgggaggctgaggcaggagaatcgcttgaacctgggaggtggaggttgcagtgagccaagattgggccattgcaacacagaggttggggtaacacagcaagaccctgtctcaaaaaaataaaataaaaataaaaaataaaggtaaagagactagttgggaggctatttgtaataaaccaggatttgtctgcctcaacactacactactgacattttgcatcagacaattatttgttgtgggagggttgtccttagtattgtagaatgtttagtagtgtctctagtgtctgtttactagatgttagacaacccctagccccctatatgacattgccaaatgtccctatggagacaatatcacccccagttgataactgtgtgtgtaacagaccatgtgagaaataaaaaagggtggatgttagacatgggtaaggacaaaatctaaaagccttggcaagtgtttggataggcttgcaactgagaaagagggagtgttgaaagctcaaacagagaaaggtcctagaggccatgtactgtagtctaatatgcttatcattgcttgaaacattgtaaaccctcttggaaggcagtttggtaaaacctattaataatcacaaaaagtatcttactttttgacccagcacttttatttctgggagtttatcttaaatgattcaaatgaagacaaggaatctttatgtacaaagcaattagttgcatgacagacagtgaccacgttctcaaaaattacacccgcatgccaccacattgcctgttaaattagaagccgatttaagatcctgagtttaagagccaaagaagttgtagctaaagaaacaaaatcccagaggggcaggaagggcagatatcaagaatgcaagtagagaaattcttaacttatttttcagagagaggacaatgaatttgagaatttgtattggagaaaagagggagagaagttaggtggaggaactcctagataaggcttcaatcagtgaattcatctgcagagcagaagtttctgcggaactcaaactgcctgggggcattccttgaaaagaagaattctgcactttttggtgggaacctgccggtggaacatcctgtttagaaatgaggacatccaaggaacactgcaatgtgcagagactagaaggaaaaaacagtcaagtagccatttctcctggggagtctctagtaacttgattttgtgcttcttcttgttttttgagacaagagtctcactctgtcgcccaggctggagtgcaatggtacgatctcggctcactgcaacctccacctcccgagttcaagcaattctcctgtctcagcctcccgagtagctgggactacaggtgcaagtcaccacacctggctaatttttgtaatttttaaattattatttatttttatttttttgaggcggagtctcgctctgtcgcccaggctggagtgcagtggcgccatctcggctcactgcaagctctgcctcccgggttcacgccatcctcctgcctcagcctcccgagtagccgggactacaggcgcccagcaccacgtccggctagttttttgtatttttcttttttagtagagacggggtttcaccgtgttagccaggatggtctcgatctcctgacctcgtgatccgcccgcctcggcctcccaaagtgctgggattacaggcggagccaccgcgcccggccaatttttgtagttttagtacagacggggtttcaccatactggtcaggctggtctcgaactcctgacctcaggtgatccacacacctcggcctccgaaagtgctaggattacagtcgtgaaccaccgcgcttggccgcaacttgatttttaaattgctctctgagtgtagattccttgtttgtttggcaagggttcttgccgctgccgctacagcttgaagccaaacatttaatgaaagagagcgggaggggccgaatagaagaatgatgggcgtggccaaccccgaggtggctggaggccgcgcccccttcccagagtgcaccgcagccgctgcattcaggaaccgctttagcttcgcccccggccggccgggcggggaagactggtgtggtctggccatggatgggctccaggccagtgcagggccgttgaggcgcgggcggccgaagcgccggcgcaagccccagccacacagcgggtcggtcctggccctgcccttgaggtccaggaagatacgaaagcagctgcgaagtgttgtatcccgcatggcagcgctgaggacgcagacgctgcctagcgagaactcggaggaatcgagggtggagtcgacggccgacgacctgggggacgcgctacccggtggggcggcggtggcggcgtcccggacgcagcccggcgagagccatacggccacctggggcccgcagagctgctggaggcctcgcccgccgcgcgctccctgcagaccccgtcggcgcgcctggtgcccgcttccgcgccgcccgcgcgcctggtggaggtgcccgccgcgccggtccgggtggtggagacctcggccctgctgtgcaccgcgcaacacttagcggccgtccagtcgtccggggcccctgcgacggcgtcggggccgcaggtggataacacgggtggggagccggcctgggactccccgctgcggcgcgtcttggccgagctgaaccgcatccccagcagccggcggcgagcggcccgcctctttgagtggctcatcgcgcccatgccgccagatcacttttaccggcgcctatgggagcgcgaggcggtgctggtgcggcggcaggaccacacctactaccagggacttttctctaccgctgacctggattcgatgctgcgcaacgaggaggtgcagttcggccagcatttggacgccgctcgctacatcaacggacgacgcgagaccctgaacccacccggccgcgcgctgcccgccgccgcgtggtccctgtaccaggccggctgctccctgcgtctcctctgtccgcaggctttctctactactgtgtggcagtttttggctgtgcttcaagagcagtttggaagcatggcaggctccaacgtttacctcacgccccctaactcgcagggctttgccccccactacgacgacatcgaggccttcgtgctgcagctggaaggtaggaaactctggcgtgtataccgaccccgagtcccaaccgaggaactggctctgacatccagccccaacttcagtcaggacgacctcggtgagccggtgctgcagaccgtgctggaacctggagatttgctgtattttcctcggggcttcattcaccaagctgaatgccaggatggagtccactctctgcacctcaccttgtccacgtaccagcgcaatacctggggtgacttcttagaggccatactgcctctggcagtgcaggctgcaatggaagaaaatgtggagtttcggaggggtctgccccgagacttcatggattacatgggggcccagcattcagattctaaggatccgcgaagaaccgctttcatggagaaggtgcgggtcttggttgcccgcctgggacactttgctcctgttgatgctgtggccgaccagcgagccaaagacttcattcacgattctctgccccctgttttgactgatagggagagggcactaagtgtttacgggcttccaattcgctgggaggctggagaacctgtaaacgtgggggcccagttgacaacagaaacagaagtccatatgcttcaggatgggatagctcggctggtgggtgaggggggccatttgtttctctattacacagtggaaaactcccgtgtgtatcatctggaagaacccaagtgcttggaaatatacccccagcaagctgatgccatggaactgttgcttggttcttatccagagtttgtgagagtgggggacctgccctgtgacagtgtggaggaccagctgtccttggcaaccacgttgtatgataaggggctgctgctcactaagatgcctctagccctaaattagtttcttgttgattgctggaaacaaggcagtagtgattctccgctgccactgctaccttttttttttttttttccttaaactcacgttcttaccttgataagcatcagtgtgctcacatttacctttatcactgcttcagtgtcacaaacctcggaaggtcttctaggaagaaccatctcatctaggtacaaaaggaaaaggagaagttggaggtggaaaaaaaacccttgatccgtgatcatttcagagcaccaacttcatcaccttcaggcttcagtgtactgggtaacactgaccatgtcgttctgcttgagacagatattagattttttttggaatttggatctttcatctgagttctttttcatgggcgggtcggggtcagtatcctgtttgttattgttaaatttgtatgaaccttagaaaagttattaaagtgccaaagaatgtttccctttcctaaggctagattattatgtgggatggttcgaagaaatgcaggagcgggaggaagatagggaaaatctataatggctgaagtgaaaagcaacctggggtggttgtagcatgtaaaaggagcatgttaatcaacctcttaaggaagagactctcaggctgggtgcggtactcatgcctgtaatcctagcactttaggaggccgaggcgggtggatcacctgaggtcagcagtttgagaccagcctggccaacatggcaaaaccccatctctagtgagaatacaaaaattagccaggcatagtggtgcgtgcctgtaatcccagctactaggggggctgaggcaggaggatcacttgaacctgggaggtggaggttgcagtgagctgagatcatgccactgcattccagcctgggcaacagagcgagactccgtctcaaaaacaaaaacaaaaacaaaaaagaatcttatctgattgggaccagttcactaactttggggataatttatgctatttaattatgcaacccaattctagtagaaaaattattttctaccagcttgttcagttttaagatcatggtatgtttttgctcactgtttgcttacatccatggctggcactgctgtcataagggcagcatgtcacctagttgtgccttcatagaccttaggcaaccaacttttagcaagctggccatgaaggaaggctactgttcaagttactttccactctcatttttattctggcagttcgaagaaacttccccaaatctgacaagtgaatattctcatggttggtggaaaagtgcctgatgtaccagaaagagcactggacttggaaccagaagacctgggtttggggtggtagctggtaggcagctggctgagtgacctgaggctgatgctacgctcaggcacacagattttgtaagtatattttggtacagtttgatttctgcaccctcatcatttaggttgcgtctgggactcttaagagtctgtcaccataatggatagttttctgttatttaaggttgagaactttacaaattctttttaaaaaagttacaaaagcatagacatacactaagtaaaaatgatagttctccctccaaccccactttccagagacaagcactattttttgtttgtttgtttttttgtttgagacagggtcccactttgttgcccaggctggggtacagtggtgagatattgggttactgcagcctcaacctcctgggctcaagcaatcctcccatctcagcctccttagtagataggactaccagtgtgtgccaccacacccagataatttttatttatttatttttttgtagagatggaggggtcttgctatgttgcccagactggttttgaactcctggcctggggtgatcctcccaccatggcctcccaaagcactgagagtccaggtgtgcgccaccacgcccaaccaccaaccactaccactattaaggttaagctcataaagcttttttgagtgcttagtcaaacatacatggtagtattgttttataaagacttgtgtttttctgatatgtccttttttgacctaacttttaagtcagttcaaatagagataacttttttttaagggagaaaataaatgaataaaaacccgagaaacaaacaaacaaaaaaaaaacacaaagactgagtggatggtagccaagagggaagagagtaccctttcctgactctttcatcctctaaggcttgctactaagtcccaaaacatccagatcctggaagaggcttattaaaggaatcaaggcatggaactcacccctaggaaacctaccctgaaaagtttcttggagtaaagtctggagtgttagtggtccttgttctcctttgggtttcaagtaaacacgttttgcttcctccctcacttttcccatgaccatctccagcttgagtattttgtgtgtcagcaagtccttttggcttagtgttttaatctaaattagaacaaataatgtttgaaaaacaaaacaaaacacctgtactaggcagcaaattatcaaaaaacattaataaagtgattgtaggaggctgaggagggaggatcacttgagcccaacagttcaaggctacagtgagctgtgatcatgccactgcactccagcctgggcaacaaagtgagaccctgtctctagaaaataaagaagtaactaattgcatatgcttatcagtagtaggtggtacataagtgcctgagaacattgttctcttatgatattggttggagattttttatacctgttcgtgaaaattttacttcagctttttgggcatgatgaacctgctaagaattgcttgcttgatgtgaagttggtttcttgaattacctttttaaagtcctttcccctctattccttcatcttatctaacagctttgaaaaattagaacaatccaggccaggcatgatggctcatgcctgtaatcccagcactttgggaggctgaggcgggtggatcacttgaggccaggagttcaagaccagcctggccaacatagcaaaaccttgtctccactaaaaatacaaaaaaattagttgggtgtggtggcacatgcctataatcccagctattttggtggctgaggcacgagaatcacttgaacccaggaggtggaggttgcagtgagccaagatcacaccactgcactccagcctgggcgacagagcgagactgtccccccctcaaaaaaaaaagcaaaaattatgttaatcctttcagctagagattttctttggtgagaaaacccagattaggaattcagaaaaattaagaagaaaatctagggggccagctctagtcccttattccttctctatgcctatttgaaaaaaaggaaaaataaacaacttgggtttggggttgatggggagaaaataggaagggagggaaatagtatttctgaaacaatgagggttacttgataggactaataggatttttgttttgtttttgtctttactagtaggaccttgtaacccaatcttgcacagatgctttgcatcttcaaatgatgtggcatctgtgtctggggttttagaaagtacttctatggtgggaaaaagggtatgtacatgtttgaggaggacagggtctgaggaactcttgagagtcctgaattttctcttgagaacagagcttgcacttatttaccctgttcttgatctcctgaagcatttcttggtttccttcatttcctaagttgagtatcttcattgtctggtacatttctctgaaagataagaagggcttcttagattattctaccctgccctttaaaaaagtatgggggtagaaaatataggacttggaatcaggtaagaatcccaagttccaatcctaactgtgcagttttgctgagccttatatgcaaaaatggtataatgcttagcttacaggaataatgtgcagtttttgagacaatatatttgtgggttttttgtttactttttgtttttgcgagatggagtcttgctctgtttcccagagctggagtgcaatggcacgatctcgtctcggctcactgcaacctccacctcccaggttcaagcgattctcctgcctcagcctcctgagttgctgggactacaggcgcgtgccatcatgcccagctagtttttgtatttttagtagagatggggtttcaccatgttggccaggctggtctagaactcctgacctcaggtgatccacccgccttggcctcccaaagtgttggggctacaggtgtgagccactgcacccggccatgcccgtctaatttttgtatttttagtagagacaggtttcaccatgttggccaggctggtctagaactcctgacctcaggtgatccatctgcctcagcctcccaaagtgttgggattacagatgtgagccacctcatctggccaagacaatatatttgaaggtgccaataggtaccatttactgaacacctttatgacaggcgctaaacatgtcatctcattaattatcaccacaaccctataatgtagactatcacctgcatttgatacatgaaaaaaatgggctcacagagtttaaataccttacacgggctcacatagctattgcatgccagagctggaattcaaaccctggtctttttgactctaaaacttgttgtcccaataggcatttgataaatgttagttgaatatatgaataacttaaaacccatcctttttttttttgagacggagttttgctcttgttgcccaggctggagtgcaatggcaccatctcggctcaccgcaacctccacttcccaggttcaagtgattctcctgcctcagcctccctagtagctgggattacaggcatgtgccaccatgcctggctaattttgtatttttagtagagacagggtttctccattttggtcaggctggtctcaaactcccgacctcaggtgatcctcctgcctcagcctcccaaagtgctgggattacaggcgtgagtcatcacacccggccaaaacccatcctggtggggagaaaagatgcatgaactacataagcttgactttcaatctaatttaggccagtttttcagttacctacttgggtgagtggtgaatgtgcaggtgaaccagtgcttttactgccattaggtagcctggaaaggcagggacatattcaatgagcaaagatgtgagagttggcagtataaggtcatggtgggagccagaggtttagtgcttactttagaacagcatcgtggttctccaggagcagcacgtctaggaaggtgtccctgacccggtccccttgaagtttcagggctaggatgctacggcaagcttccagccgtacacctggtgactcttcatagtggatagcccagagcagaagatccgtcagctcgggacttacttgcccaatctgtcccaaagctgcagagattagagggcagcatgtcactgaagactgagcttactatattctagcatccagaaataaattgagttttgcaaacaataccttcccttttggatggtaatcaccattagaattttagggataggtcagaatgggacattacctccaaaggattcctagaagagggatgttccatcccatccttgcctgttaggatatttgcctattttgggatgaaatatagaacaaataacatggaagacctgcctagtcccagcagggtgatggggaaaggaggcacaattatttatctatgtcaaaaagagaagcaatgccaaagattctaaaaagaaactaggcagattaaggggcagggttttaggtctgtagcagtcttgaaactgatctgacttttgcagagcgtaatagttgagatctccaaggaaagcaagatgcatccagcactggatacctacttggaacttatccttaattctgttggcagggactgtcttgtcagccctttctttaacttaagtttgacatatacctagactcaggatctttcactaaaaattgaagaaaattatctttctcttttcagacaaggaacttctgaaaagctaagatcattacctctcctgcacttcaccccattagagagtttcaggggatcatttctacttgcataggcaaaggtatttaaggttgaagagtttggggcactacttctataatacctcgaatggcaaaggccttgattttccagtaaggatctctctgcatcaggttcaggaggcattcaagcacctgggatggaaaaggcagtgttgagtggggaggaccagagcaagaatgaaccagaaacagctgggtgcggtggtgcacccctgtaatcccagcattttgggatgccaaggtgggcggatcacttgacatcaggagtttgagaccagcctggccaacatggtgaaaccctgtctctactaaaaatacaaaaattagccgggcatggtgtcacacgcctgtaatcccagctactcggaggctgaggtaggagaattgcttggacctgggaggcggaggttgtagtgagctgagatcgtgccactgtactccagcctgggtgacagagcgagtctccatctcaaaaaagcaaaaaaacaaaacaaagcaaaagaatgaatcagaaacagggaaaccacttatctctaaaaggagctataattgaaaaatgacctatcaattctggtgacaaatgagctggagcctaaagtaccaacctatatgcatagtgagtacattagctgaattatctgctattgattttctcagtctacagatctggggccatatggcttctcttgaacacttcaaacagatttttccctaataatggaattataactccatttatgggagttgatcctaaagcccatcagcacccaggtaatgagaagctagttaactgaggtgagaacaggattcaggggtgtgctctagaatcgaagtctgggctggctgggagctaaaccaagcttgtccaacatgtggcctaggacaacttggaatgcggcccaacacaaatttgtaaactttcttaaaacatgagatttatgccaggcgcggtggctcacgcctgtaatcccagcactttgggaggccgaggcgggcggatcacgaagtcaggacatcgagaccatcctggctaacacggtgaaaccccatctttactaaaaacacaaaaaaattagccaggtgtggtggcaggtgcctgtagtcccagctacacaggaggctgaggcaggagaatggcgtgaacctgggaggcggagcttgcagtgagccgagatggcgccactgcactccagcttgggtcacagagcgagactccgtctcaaaacaaacaaacaaacaaacaaaaaaaccatgagaattatgcacggaccttttttttttttttttagctcatcaactatcgttagtgttagtgtactttatatgtggcccaagacaattcttccattgtggcccagggaagccaaaagattggatgcccctgaaacagtcctgtttgaagtggcttatacacccccttcccagttccaatctctcattctgtgtccccacagaatgttgagcatactgtgcacaaccagggaaggtaatgccctcttcaggtcaatcaggtaagatgagaatatgtttccctgactcaccatcttgtcgcggatctgcagggcaccagctgccaaacaggctgcccgccgaactgctgtgaagtcatcagagaagcagtgcaggaagcttgggagaagcttggcggtcataagcttgagctcacctatcaggtagagagcttccacacgctcctgggaatttccttgacctagcttgaccctgtaaggcacaagttgctttcctttcacctccttaaactttcagtacctaacccccaacccccactaatgccctcatgataaaatccgggttctgtaggctgtcaatcccattcagccttatgctcatgagataagttttactgggtacagagctcgattgtcttctttacttgaatccctaatacatagctgttcagtaattaggtaatgcagggctttcagttacactgaatgactgaataaaggaaaatgtcaacttgcacctcttttcacagtcaagttctcttctccattgccctcacgtgtgccatgattatgtctgcatttggcttccagcctggaatgcctatgcagtctttttgtttgtttgtttaaattatttttatttattttattatttttttgagatggagtctcgctctgttgcccaggctggagtgcagtggctggatcttggcttactgcaagcgccgcctcctgggttcacgccattctcctgcctcagcctcctgagtagttgggactataggcgcccaccaccacgcctggctaattttgtttttcttgtatttttagtagagatggggtttcactatgttagccaggatggtcttgatctcctgacctcgtgatctgcccgcctcggcctcccaaagtgctgggattacaggcatgagccaccgcgcccggccttaaattatttttagagatggggtcttgctatgttgcccaggctggtcttgaactcctgacctcaagtgattctcctgcctcagcctgagtagctgggattataggcacttacccactctgcggctcctatgcagtctctctctcttttttttttttttttttttttgagatagggtctttctctgttgcccaggctggaatgcagtggcatgatgatggctcatgacagctttggacttcctggacccaggcagtcctcttgcctcagcctcccaagtagctgggactacaggcatacaccaccacactggctaactttttattttattttattattattatttttgagacggagtctcactctgtcgcccaggctggagtacagtggcgtgatctccgctcactgcaagctccaactcccaggttcacgccattctcctgcctcagcctcccgaatagctgggactacaggcgcccgccaccacgcccttttgtatttttagtagagacagggtttcaccatgttagtcaggatggtctcgatctcctgaccttgtgatccacccgcctcggcctcccaaagtgctgggattacaggagtgagccactgcgcccggccaattttttttttttttttttttaatttttagtagaggcaaggtcttgctatgttgcccaggctggtctcgaactcctgggctcaattgatcctcctgcttcagagtctcaaagtattgggattacaggcgtgtgccactgggctgggcctcctgtgcagtcttatccaccctctgtgaaacttggccttactcctctagccacgctgagtattccatttttctgctccagcagttatggtatatgccatttgttctagtttttaatgatttggtatttttaattaggtgtttgtatattttgcatgtggtcatcagaattgcgtcatacttttgaacaccctccagcaccgaaaccattgcctcacacctactgggcactcaatgcttctttccctagccacattgttagtttgtagggactgttaattttttacagtgggacctggtccagggtccgtacagaggagctcaacaaatgctgggtggctggatcccaggcctcctaagcactttttttttttgagacggagtcttgctctgttgccaggctggagtgcagtggcgcgatctctgctcactgcaacctccgcctcccaggttcaagcgattctcctgtctcagcctcccgagtagctgggatgacaggcatgtgccaccacgcctggctaattttttgtatttttagtaaagacagggttttactgtgttagccaggatggtctcgatctcctgacctcgtgatccgcccaccccgtcttcccaaagtgttgggagccaccttgcccagcctgcctcctaaacacttctaagaatttagaagagtgtctcctcatgttgactgggtcttacctgattatgtcgtgcacctctttcccgaggctcatttgcccaagcgcctgtgcagctgctctcctcacttccttattccagtcattccacatcagctggatcaacttatgtttcatatcctataaataggtatgatcattaggtatcatcacttaatgaatgttaattttgtgcttggcgttgtgctgttttttcttctttttttactcatcactgtactaatgaggattgtcctgagtgttttttcccatcgcttactctcccaaagaatccagtggggcagatattactaccatttacagatgatagaatggaggctttgatcagcttgtccaaggttaacctggtgagtgctggaaccaggactcaaacccaactctcccaagctcatcctttaaactatgtagtatcagtgccaacataacttgtacctgggagacttaaaatttgaaagtgatacttgatgaagtgactagctcattgcagtttgcctgggactctcctggttttggtcctgaaagtcccatggcctggacaaaccagaacagttggtcactctataagtgcacttctctcagagaggaatgggcaaagattactacacgatgatgtgtaaatgtgcccacgctgttcttcctgctagaagtatctcccttctctactcctacctggtacttgatgtctttgtagtcttcctttaggatttacctcaaaagcatctccttcctatctcttttattaaaaattttaaaaaataaaataaaaacatctccttagtgaagtcttctttgccccttgtaagcacaggaaatccccacaacaccttatagctgcttctgttctagctatttgtaacatttactaacggaagacttatccctgcacccccaggggtagcatagtgcctagtgcgtcggatgtggtcagaaactgcatgcttactgaatgagtgaaaagactcatagacatactgcctttcttagctccagcaatctgccatgaagtcctcatcatctttacctcaacccctgctagctctgcatgtctttttactttcagttgtcaattctaagtgacaagtgccaaggaggtgaaggtacaaatgaattggaagttgttaaaatgatattgttaagatgcagattctgattgagctggcttaagatgagatttttgcatttcttttttttttttttttttgagacggagtttcactcttgttgcccaggctggagtgcaatggcacgatctcggctcactgcaacctccgcctcctgggttcaagtgactctcctgcctgagcctcctgagtagctgggattatgggcatgtgccaccaagcctggctaattttttttttttttttgagacggagcctcgctctgttgcccaggctggggcgcagtggtgcgatctcaactcactgcaacctccacctcctgggatcacgccattctcctgcctcagcctcccgaggagctgggactacaggtgcctgccaccacacccgcctaattttttttatttttagtagagacagggtttcaccgtgttagccaggatggtctcgatctcctgacctcgtgatccgccctccttggcctcccaaagtgctgggattacaggtgcgagccactgtgcccggccgatttttgcatttctaataatgctcctaggtgacgcctgtgctgctggtccaggactttagcagcagggtgctatagcacttgagacagaactaacccaagtccaaaaccttttcaggtgattactgtactgagtggccagattttgtgcttcccatatcaaaatgtcagggttacagagtggaggttgttcacttatcatgggaatggcaatgttctgggctattctggagatatccaaagttataaggaaaagatgaagtagcacataggaagaagggaaagctcccatttggacagctgaagatgattgggaaataatggcaaaaacgaagtgttgcctggaattccctctttagttctagctgagccccaccatcttcaccgacagttggtttgtttttttttttagatggagtctcgctctgtcgcccaggctggagtgcagtggcacgatcttggctcactgaaaccgccgcctcccaggtttaagcgattctcctgcctcagcctccaagtagctgggatgacaggtgtgtgccaccatgcccagctaattagagatggggttttgccatgatgaccaggctggtttcaacctcctggtctcaagtgatccacccgcctcagcctcccaaggtgctgggcttacaggcatgagccaccgtaccggaccccttcacagaactttaaccaataaatttaacccacactaatctctctctctctgaaaagttttaaaagggtaccttatatttattgcttgttcttgaatcatttgtgtatattagtcttattgttcctaccatagtgttaattttgtgaaagttgggacaatggtttttttgttttgtttttttttgttttgttttttgagacagagtctcgcactgtcgcccaggctggagtgcagtggtgcgatctcggctcactgcaacctctccctcccaggttcaagcaattcttgtgcctcagccttccaagtagctaggattacaggtgccagccaccacacctggctaatttttgtattttagtacagataggatttcactatgttggccaggctggtctgaaactcctgagctctgatccacctgccttggcctcccaaagtgctggcattacaggtgtgagccaccgtgcccggccgggactatgttttatatgtgtgtgccgaacactctgagaagcagcacagacactcatttagatgggtttttgggtagtctaagtcagtgcttctcgaatgatctttgatgaagaaccaattttggcgggggggaaatatgtcattgactgataaagtctgttgatattgaggcaatatcaaattactataaacgtttcttttttttttttttttttgagatggagtctccctctgtcacccaggctagagagcagtggtgagatcttggttcactgcaacctctgcctcctgggttcaagcgattctcctgcctcagcctcccaagtagcagggattataggcgcgtgccaccacactctgctaatttttgtatttttagtagagatggagtttcaccatgttggtcaggctggtctccaactcctgacctcgtgatccgcctgccttggcctccccaagtgctgggattacagatgtgagccaccgcacccggcctactataaacgtttctaaactcctgtcagtttttgtgctatttcattgtggatcagttaccaacagtttatggaccaccagtgcactgagaagcattggcttccagacagacatattagcatttgaagataattctgggctagaagtaagaagtagtgatgtgggaacagagatctgtttggtaagaatggaataatacatagcagcaaaaagtagaaggcctctgtagctcagcctctcttaggctttctgtcctggaggcaaagaaagaggtttaccaagcagacatttccactgatccgggagaaagcctggcaggccacaatccggttcttccattgacagctgttcagctccacagcaagcatggtgtgtatcagggtctgaggaaatggaagacttgtatggatattcacaatcacttttagagatactagaaccttgaagttacattctgaaatggcatcctgcataattaatgtcaccagtgggcttacaagagatggggcatgtttccatcacagccaactgactctgggatcataaattggggaacaaaatacaaatttaataacttaaacagaaaactgggaccttcctttcctgactttaactgtttttttttttttttttttttctgagaaggttgtcccccaggctggagtgcagtggcacaatctcggctcactgcaacctccgcctctcgggttcaagtgattctgttgcctcagcctcccaagtagctgggattacaggcgcctgccaccacgcccggttaatttttgtatttttagtagaggcggggttttaccatgttggtgccaggctggtcttgaattcctgacctcaggtgatctgcctgcctcggcctcccaaagtgctgggattacaggcgtgagccaccgtgcccggccttctgtctttaactgtttttacccctaaaatgatttttatatgcctcaagcttatgactttcacatttctattgaaagtaactaaacacaaatataggcctctgcagttttcaatggtaaacttctagcagaagcaaattctacatgtcagaactcttcttgcatatgcaaatagagaccatttgcaacctaattctcacttttctctcagctaactattgtgacttccctttgtatacacctctacacccaggtttactcatgcttattctacgtttacttatgcttgagattgtcaacccaaccggctgcattttatctaattaattaattgtgtaattaattttttgaggcagggtcttgctctgtcgctcaggctggagtacagtggtgtgatctcagctcgctgcagccccaacctgccaggctcaagtgatcctcccacctcagcctcttgagtagctaggattacaggcacataccaccatgcctgactaattttatttctttttttgtagagacagggtctcactatattgcccaggctggtcttgaaatcctggactcaagggatactcccacctcagcctcccaaagtgctgggattacaggcgtgagcgaccatgcccagcccagctgcattttattttatttgtttgagacagagtcttgctctgtcacctaggctggagtgtagtggcgtgatctcagctcactgcaaccttcacctcccaggctgaagtgattttcatgcctcagcctcccgagtagctgggactactcagtgtggtaccactgcacctgtctaatttttttatttttagtagagatgaggtttcacccatgttggccagtctggtctcgaactcctgacctcaagtgatccacctgcctcggcctcccgaagtgttgggattacaggcataagccactgccccggccccagctgcatttcagattgcttacattcactgacctcaaagacctaattgctccccaaaactgtgtctgacccggtaatggacacatactgtcttctcactcagatagctcaggaggatataagactgttcctcagtgtcctcattcttctttgtaaacagctggtggaggatcctcttaatcacagggtaagtagcagtaccttccagagccaagcactgagctgcagcccagctatccacactgttacctgccacagttgggtgaaaaagagttcagaatggtgatgtgttttccccctagagaacagcctttggattgatacccaaggctgctaccccacctgatatctcacttccttgtgccccactcagtctagaaatacaatttcttatttaaaccatattgagaagaatcatattggctgggcacggtggctaacacctgtagtcctcacattttgggaggccaaggtgggcggatcacctaaggtcaggagttcaagaccagcctggccaacatggtaaaaccccatctctactaaaaatacaaaaatcagccaggcgtggtggcatgcgcctgtaatcccagctacttgggaagccgaggcaggagaattgcttgaacccaggaggcggaggttgcagtgtgagctgagatcccaccattgcactccagcctgggcaacgagagtgaaactctgtctcaaaaaaaaaaaaaaaaaaaaaaaaaatttagtccagctaccacttggtggcagtgtacctgttttgttaaagtacctagaaagagcaaattttctttttttccttttttttagagacagggtcttgctctgtcacccaggttggagtacagtggcaccattgtggcttattgcagcttcaaccccctgggctcaagctgactctgataagcatgtatatataggtctgcctcagcctcctaggtagctgggtctacaggagcacaccaccgcacctggctaattttaaaattttttatagagatggggtcttgttatgttgcccaggctggtttagaactcctatgctcaggtgatcctgtcgccttggcctcccaaagtgctgggattacaggtgtgagcgacagtgtctggtcctaattttcaaatggtctaacataaatctaaacccaatacagcagacattgcagagcatcacagtggagaggaaaggactgggaaagctgatagtgagatgtctatcccatatttccaggtcagaagtaacagggagttactcacccttcagaagggcagtctgcatgatgttccgggcaaggggattatgtgactgtatggcatattggcatattgctgctgccatccgcacatgggcattcttgtcacaaagagcagcctctagggcaggcagtagaacctccggcaagtcctggatggtcttgtctgtgatcaaaagagccaggtaagagagtactagcccctttgcttttctcacacacagcttccttcctacagccatgtggtggccaacctcagtcccagctgcagttgcttagtgctatgtaatataattacagtttagctgagcccttcagatgggcaggattttctgctcaaggtgttaaagctcacctgtgtgctggtatgccaattcccaatcctttatcatctggcctctaaacagctatatttaagccgaagaagaatgtttccagctaggctacagtgaactacaccattagttttagtgattaaaagcaaccaatttgccccatgagcccatatatatatatatatatatatatatatatatatatatatatatatatatatatatatttatttattttatatattttttgagacggagtcttgttctgtcacctgggctggagtgcagtggtgtgatctcagctcactgcaagctccgcctcctgggttcacaccattctcctgcctcagcctcccgagtagctgggactacaggcacccagctaatttttagtattcttagtagagatgggatttcaccgtgttagccaggatggtctcgatctcctgaccttgtgatccacctgcctcagcctcccaaagtgctgggattacagacgtgtgccaccgcccccagctgagcctttatatttgtaagaacaattatatttaggtagtgctttataatatagtgtttttacattatcttgttatctttcaaccttggttgaattaggcaaggtaggtatcattgtagagctcactagggagtcttttttggttcaactaaacagtaaggttcataagactgtcatgggccatgcatggcaccagaagaatatgggacaggagcatagtttgtcaacagggcagcagcatcaggcatccctgttggctggagtttttttgtttttgtttttgttttttttttgagatagagtttttgctctgttgcccaggctggagtacaatggcacaatcttggctcactgcaacttctgcttcctgggttcaggcgattcttctgcctcagccttccgagtatctgggactacaggcacctgtcaccacgcctggctaatttttgtatttttggtagagatgaggtttcaccatgttggccaggctggtcttgaacccttgacttcaggtgatccacctgccttggccttccaaagtgctggaattacaagtgtgagccaccacacctggctttggctgcagttcttgaggctgtcttgagcattccacagagtcttggggacagcacaggagcatgttgtttattcactgggtgaatttatgctttacaggaactaatatctcttataaaaactccatagacacaattctagggtccacaaagggcctgcctgttataagttacagtatccagggaggcccaaactatggtgtccctatcaagtatttatatttcacttatagctcttctcagtcccaatgtaatttatcaaacaggatttatatcataaccaatgttgcctataaagatagttcttatcaggtgtttaggggaacaggtgggcatttaactgaagttcaaattctcaagtaggaaggggaaaggtttgttatccctttgtctaccactagtctcattttatagataggtaatttgaagctcagagaggttagctgactgcccaaggagtggcacagctaagcccgtgaatcatattttaagattttgtcaggtgcggtggctcatgcctgtaatcccagcactttgggaggctgaggtgggtggatcacttgaggtcaggagttcaagaccagcctggccaacatggtgaaaccccatctctactaaaaatacaaaaaaatgagctgggcatggtggcacacgcctgtatgtagtcccagctactcgggagactagggcaggagaattgcttgaacctgggaggtggaggttgcagtgagcagagatcgcgccactgcactccagcctgggtgacagagcaagactctgtctcaaaaataaataaataaataaataaataaataaataaataaataaataaaataaaataaaaaagaatgggctcttggctgggcacagtggctcacgcctgtaatcccagcagtttgggaggttaaggtgggaggattacttgaggccaggagttcaagactagcctggtcaacatagcaagacacagtctctaccaaaaacaaaaacaaaaaagaatgggatcttcaaggtgggaaatgttaacttctctgcaggccactgagcaaacaaaaggtgatgaaatgtagttcaaaaattactggactagaagtctggaattttaatctcgtctctattgctgataagcatgtatatataggccagtctctaagtcttggtttccacatttgtaaaatgatctcagataagccctgggtccctaccagttcagatgttccatggctttatgagttgcttatgttctcaagcagttcagctttggctctcacctgagtctctctggctggtggcaatccggggccgttccaaagcagctgtggcacatgtggtgatagctttgatccgaacgtcatcatgcaggtctcccaagctctgaagcaggttctctactgtctcatggtgccactctatgactgagccgcagtgagggaaatgaaaagagaaccacctggttagggttagatattgtgctgcaggcaggtgacaagaagtctgcccttcacccagaataattcaagcaaaacattagctcagaagaataaagggcccagagatggggtctttagggagttatttctctgatgatccatgtaccctcacaagtaagttcccagacaaaacttctcccaaccccatcgtatctatctctctttctttaaatcacttttcgttgtaaccatctgggaaataaaagtgacaataaaacaaagtagttaagagtactttgttttcagacatacctggtttgggatcacagttattagctgtgtgactgtggataagttacttaaccctgagcctgagatttcttatttgtaatacaggcataatactagaacccacatattgagttattcttactgttaaatgagttaactagacaaagtgtttagcaaaatgcctggcaagataatgaaggttcaataaatgttaactattgtggttttcattaggttctttgtctttgagggcacttccatttggctttcaacatcttcctcattttagttgctaaatactcttttggcaggtatcagacttttatttcaaagctcctattatctgtaggtgtttccttcagtcttttttgttattgtttatctgatccagtttacctaatggattgcctctctttttcctgcactaactaagcttgtctatcatgttctgaaagccagcagctattgagttctcaaataccatagctttcaacagtccttgccaggccattactttgtcccaggcactcagacttctactctcctatctttgaaggcaaagtaggtataggatagccccaactctacgaatgaattttggagaggggttgctgataccatagtcaactatgacatggacaatggttggacagcatattttgttcttcccttcatacatcatttgctgagcataaagtttggaaaacaataagatagggtcgcctgggtgcagtggcttatgcttgtaatcccagcactttgggaggccaaggcggggagatcacctgaagtcaggagttcgagaccagcctggccaacatggtgaaaccgtgtctctactaaaaacacaaaaattagccagacatcatggcacatgcctatagtcccagctacttgggaggctgaggcaggagaatcgcttgaacctgggaggtagaggttgcagtgagcccaaatcaagtgccatggcactccggcctgggcaacagagtgaaattccatctcagaaaaagaaaaaagggctggcgcggtggccaaggcgggcagatcacctgaggtcaggagtttgagaccactctggccaacatggtgaaaccccatctctaccaaagatacaaaaagttaaccaagtgtggtggcgggtgcctgtaatcctagctactcaggaggctgaggcaggagaattacttgaaaccaggaagcagaggttgcagtaagctgagatcccaccgttgcactccagccaaggcaacaagagcgaaactacgtctccaaaaaaaaaaaaaaaaaaaaaaaaaaaaatggtctctgcctctgaagagtctgcagtgtaataatgagtttccacaaattactgaagtaatacccatccatgcaaaaagcacccagatatatgttaactgaagttcatctaacacccaatgtgtgaaaggctcttgtctagccttaatgaggcaaccagatttttacatttcacaaaggagggatggatttttcaaagactgagaaagcctagtcccagatgagaaccacttctcacaaacgtacagtatcacaggacctcccttcactcactcagagcccaggcagtcttccattccttcagcatcctccgcaggaccaccagttcccaggtcacatcctcctgcagtgattttgcctgcttcttcaatctcctggtcttaataggcacatccttctcacccacctgcagcagcatatccttggcgggggtgggcaaagcagtccagcgcagggctccttgcacaggtctgtaagctgtgcaacgtggcagtgtgaggtcttttcaccccactgccttaggccctgccacacagtggccccagcttgcatcccattcctattcctgactaataccaaagcaaaacaaaaccctcaagagtgaatttccccatgattatatggggaactgagtacatgtacacagggaattatggaaagtcctgactagacatggtaagccatgatgatgatgggggtgagagatttgtggggggaaattgagatatctacaaacctttctataagtttaaaggttatctttaggaacctaaatctttaggaacataaatatgtttatatgtaacgagatttgctcataatatttgatacgttgcaatttagtgtcattggccattatttctaaagtattaagttttccttttaatgtttttaatttggggagaataatagtgctataagctgtgaaattttaaagattttaacatctctgagtttttcctcaagacaacagaaatttgagaacagaagaagccgtaaatattagatatagttagaaaagctatagttggccgggtacggtggcttttgcctgtaatcccagtactttgggaggccgaggcgagcagatcacgaggtcaggagatcgagaccatcctggctaacacggtgaaaaccccgtctctactaaaatacaaaaaattggccgggcatggtggcatgtgcttgtagtctcagctacttgagaggctgaggcaggagaatcacttgaacctgagaggcggaggttgcagtgagctgagattgcaccactgcattccagcctggacgacagagtgagactccgttctcaaaaaaaaaaaacaaaaaaaaaactatagttatattttctgaacttaatgtttttcatggtgtcaaatttagaaagcctctttctcagaaaaaaagctctatggagaaggggaagggaaaaatgataaaaacatttccagatgtactaaattcattattcacactgcctattagtctcatgttctaatcagtcactatcagccatttctgtttttttccaagatttcattctgactcttaacacctttagatttgctctgaatcaattctttcctttgagcaaggaagacataacatttctttcttctaatgtaaaaagagtcctgtgaggcggggtgcagtggctcatgcctgtaatcccagcactttgggaggccaaagcgggtggatcacttgaggtcacaagttcgagaccagcctgaccaacatggtgaaaccctgtctctactaaaaatacaaaaatttgctaggcgtggtggtgggcgcctgtaatcccagctactcgggatgctgaagcagaagaatcacttgaactggggaggcggaggttgtagtgagctgagatcgcgctccaacctgggtgacaaagcgagactccatctcaaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatcaaaaaaaaaaaaaaaaaaaaaaaaaagagtcctgtgagactccagggcagtttagcaaagatgcccatacaatgcatctcctccaaatggtccccaccagcttggacgtgctgggggactcagccactctgctgaggcctccctcctttctggggtagggtgtgtgcaactaggagctgtggaaccacctctgacaggccagctcacactttgccatgtgacgctccccgacttctctcaggcgatttgaaatccctcctgaagagatgagaagtagctgaattaaccccatttctcctatatccctctgctcaaggagttaaaatggatttgcggtgagcaagtcttagatctctgatatttaacctcataggaataaaaaatacaactgccaacttttactttggttccagtcctttgggttatagctggatagaaacacatccactagccatcttccacatcaacagtcatctaaagctggggtccctaacccccaggccatgggcctgtaccagttcatggcctgttaggaaccgggccaccacaacaggatgtgagtggtgggtgggcaagcattaccagtgagctctgcctcctgtcagatcagcagtggcattagagtcacgtagcatgaaccttactgtgaactgcacatgtgaggggtctaggctgcgcaccctttatgataatctaatgcctgatgatctgaggtggaaccatttcatcctcaaaccatccccaccccgctggtctgtggaaaaattatcttccacgaaaccggtccctggtgccaaaaaggttgaggactgccgatctaaagggagcacacaaagtaatgactcttggcagggtacagtggctcatgcctataatcccagcactttgtttgggaggctaaggtgggaggaccccttgtggccaggagttcgagaccagtctgggcaacatagtgagaccctatctctaaaaaagttaaaaattagctgagtgtagggtgcacacctgtggccctgatcctcctgcatcagcctcgcgagtggctgggactccaggtgcgtgccaccatgcccaactaagttttgtatttttttgtagagacggggtctcaccttgttgcctagactagtctgaaactgctaggctcaagcgatctgcctgcctcatcaaattgtatggtttaacaggattaattttatagtatgtaaattcaagctcaataaagctgttattgaaaaagaatcctctggctgggagagtggctcatgcctgtagttccaacactttgggagtctgaagagggtgcatcacttgagcccagaagtttgagaccagcctgggcaacacagcaagaccttgtctttacaaaaattagctgggtatagtggtgtgcacctgtagttccagctactcgggagagtgaggtggaaggattgcttgagctcaggaaggtaaaggctgcagtgagccatgattgtaccactgtgctcagcctgggaaacagagtgagaccctgtcaaaaaaaaaaaaaaaagaagaagaaaagagagagagggaaggggaggggaagggggaagagaggaaagggagacatgaaggaaggaaagggagaaggaaaggaaggaaaaaaaggaagggaggaaggagaaaagaaaaagaggctggacacggtggctcacgcctgtaatcccagcactttgggaggccgaggtggacagatcacgaggtcaagagatcaagaccatcctggccaacatggtgaaccccgtctctactaaaaatacaaaaattagctgggtgtggtggcgcgcacctgtagtcccagctactcgtgaggcagaggcaggagaatcacttgaacccaggaggcggaggttgcagtgagccgagatcacgccaccgcactccagcctgggcgacagagcgagactttatctcaaaaacaaagccaggttgtgtggaaatcctgtggctgtccacagctgtctggcgggtgcctccacagcaggcacagaatgtgcctgtgcctccaaggatagactgagcccagggaaggacttcttgccaagtggatgcaaaggcacaactagcaggccaggcaaccctgtcagccaggtgtggaggcatgcacctgtgattccagctaccctggaggctgaggcaggggaattgcttgaaccaggaagatggaggttgcagtgagcagagatcacgccactgcactccagcctgggtgacagagcaagactctgtctccaaaaaaagaaaaaaaaaaaaaaggaatgggtgacaactgctgttagtttctgcacaccactgggcccatctgaacagtaatcctacaaagagtcatgggaaatagagtcttgtggaagatgtgcacattttgtttcataagctaatttcttggtcaccttctttccctctttgtcttacagagtgaagaatgatgaacttgtgaaagttcaggtatgggtgggctgagtgtggagtgggagggtagagccagcccaagggaaaagggcagaatgctgggtcaggagtttgatgcactttccctgttaggtgcactttccctgttagcattgagataggagctgccttattggtaactagtggccctaaaccacttggttatacctaagttatatcagatctcaagtgattgtatgttcctgtgaggctcttcctagttatagttagtattttataattttgtgagattatttttagtacgtagaaaggggattgcctagatgctaatggtgcttcagcccatgaactgggagctctagcacatgaatagtgggtaatgatgggaagtagccacattcccgttattaacccctgccttccctgttagcttcctgcttacatgcttcaggaattgcctgggcactccacttttctggagtttcagggaagaccttagatagctgcttgttgtaccgatttaggttttccaggacaatctggtctctctttgcaccaatctggtggatgatctggacttcatctgtgaacagacaaagaaacaatgagtcccctataacctccctatttcctttctccctgggttcctaatcaccaggatcagacccaacttccttttgccctaatctaagcccctaggatccatgactgccatactctggggcatcccttgaaggtgaccattgcttagaaatatcacagtgataaatcactatagtgtctgtgggggaaaaaaaaaagaaaaaggaaatgtcatagctagtcacctcattagaggcctgggagccaaggatggtgatttccttcctaaggcagaacctatggccgggtgtggtggctcacacctgtaatctcagcactttgggaggccgaggtgggtggatcacatcatcaggagttcgagaccagcctgggcaacactgtaagacccccgtctctacaaaaaatacaaaaattagctgggtacagctactcgggaggctgaggcaggagaatcagttgagcctgggaggtggaggttgcagtgaagatagcaccactgcactccagcctaggcaatgggagtgaaaccatttcaaaaataagaaaagaaccggctgggcaccatggctcacgcctgtaatcccagcactttgggaggctaaggagggcggatcacaaggtcaagagattgtgaccatcctggccaacatggtgaaaccctgtctctactagaaatacaaaaattagctgggcgtggtgatgcgcgcctataatcccagctatttgggaggtggaggcagaggttgcagtgagccaagattgtgtcactgcactccagcctggcgacagagcaagactccgtctcaatagaaaagaaaacaaaagaaaagaacctatgtaaccacttagaggccttatcccttataaaaagctagatactaaaaaagaggcacctaattaatctcatcagtcatgaatacttagagtaattttgttaaacactttgagaagactttcagctgcagcagtttaggaacaagatggggcttgggaagaagaaacagcttggaacacgaagacctagattgagtatcctggaagcccaggcatctaagggacagcagtagggacagggaaggtggcaaacatttactgaacaccttaaacagacattgagcaagaagcattacagatgctttctcatctactctactcaaagtgcatttttgttaacatcacttcacaaataaggtacttgtggctcagaggaattatataatttactgaaggttactaaaaaaatactgagccaggatttaaacccaaatgtgcctgactccaaagccctgattttttccaacatagcaccttggtgggagaatatctcgaagtgggagaatatctcgaagtgagagaagggagaagggtagatagagaagagatggattgttcccaaagtcttgccaactttacagttccacccttcattgcctctttagtaagatagagggatagagaaagcggggagagagagcagttccctccctattagttatcactccccgacccaactcctgtgctagtgtgggtgctgggtcatgaacatgaaaacctgggtcatccagggcctcttgtccatacccacaactgtttccagcccccagcaatcttccaccttcctggcccatgtccccgtgtgcccctaccacaggggcccagctctattaccaaagtaaatctcctgttcaaaggtgttgtctgtggagtaggcaaactttccagctcggggagtcacctggcgaaagtagctctgggtttggggctgggagaggctcgtcttttcatggatatcctcagtgctcttgttgccaggcatgatctcaactgtctctgcttgttggaagtaactgggcaatcttggcaggggtgagaaaggagggaaaagggggaaagagtaggaggtggatccccctttccattaaatccacagctcgttccctttcctctttaagctcagctcctatacacgtgagcattgcagaacaccaatgtttaacttttagccttgtccccatggtgccagttgaatgtggagctgccagaagggcctgtctacagctgtcctgcctggctactaaaggatccatgccttctgcagccaccaagcagcagggcagagtggcggtgctccagcataacccttttttaacattcgtactcttagaggcggcatggccttggggaagggatcccacctccttcgtcatctcactctgtctattctgtgtgtggttatttaatgtccatccacctggtggtggacaggctgtaagctccttaaaggtacatatctgtgtctgttgcttttacattgtattcccagcactttgcagagtgcctggaaagtagcaagaacataatttatatttgtccaataaatgaataaataaatggatttccactgatttttagttcactcttggaaatcagggatagtgtaatagctccagtcttccctctagctataaatgagatagaagcaatctaagaaacatgtagtcatcttcttctctcaggttgtctggttctctgtcctgcagctagtcagtttttgagtcagtgacacactggttccttattcagagtaaggcaggaccaaacctcggtgctatgaggttcctgccttcctcactccaccaaggatacatttctgggagcacctggttggtaactacaccagcagtctgatggcaaagtctgctggagaaggttgagaaccaatccctttaagagcagtggttcccagctgggaatgactttgttcctcttggagacatctggcagtgtctgagacatctttggttttcacagctaggagtttgtgctctggtgggtatgagccagggatgctgcttgcatcccataatgaacagggcagctcccacaacaaaaattatccaacccagaatgtcagcagtgcaaattgagaaaccttactttgcagagctctcagagagcaggccggtggtggagaacatgaagttgatgggagagtgcattctgaaatcgggagtgtgagtccacctgggagtccctaaaggggagtcagggattatcaaaggtgcacttgaggccctggccagtatacctgtagtaaacgggaagcagcagttctggcttcttcttttcctgtgggggcaggatgacactttgatcctcaaactctgctgtctcttctgcctccagctgtttcaggagctccaggtcactggcagaggtaagctcatcccgaatgtgactccagtcgtactgctggcgcaggaagctctgccacttgttgggggatgccccaggccttcgaggacgcttgctctggatccatcgggctgtgcgctcgttcagcttttccagcacagtggcctcccacgctctggcctccttctcaggaggcagaagccaggcttctctttcctccaggttcacatctagagaaggtggccgacccagcatatctggatgcatgcagggatgatggatgagagggcggggtgcttcccggacggtgctggctggctttgatttcttcagcttcttttcgggattggcagagctttctgtcttcacagccagggaggtgtctcctgttaagggacttgaggaacccaggaacttgaagctaacaggtttctgaggccgggccttcctgatctggggagtatggatgatgtcattggtattgtagaggtggtcaaagctgtactggctataaggaatgctgggcaggcctcgctgccacaccacctcctgagagaaggtaaggtttgcagcagccattttcaaatattggctcttgcggtgtagacggtactgtgagctgaagaagaccataggcacactggagacagaggcacactcctccttgcctttcaattttgagtagtttaaaatcatgccccatcccagtcgtgggggcagtgactgatagaagcaatgggggagaaaggtctttcccttctgggtcctggtcataccgcgtcccagcaaatgcttccttccacactgcctggcctagaggaaaggcctggagatgagacctggcacctgttaagggaatgggaggaactgatgagaactctagagcagcagaaattggtagcccatagcagttcagaaagagaataacttgaaaaacagatggaaagggggtggggaagagccatgtgagttagaagaacaaaagaagaaaatggtgcaacatcctaaatatttcatgtatcagacccgtgtttttggttcttatacttgttcccaaagctcagaccctcatctccgtgtgagggatgactgcttttcagcagtatcccatgcttccagtttgtctttaaatgttgctttctttcattcaaaaggcttatagtgtaaagttcagactattcagcatggcattcagggttctccatgagtttggcctcagtttatgactttgtcctggcatgtaacctctgcttgagccagtccagtctcctggctgttctctgagtatcctctctccacataatgaagcttccttctgtgtcctctacatgaaatggcctttcgtacttgacacaaattctatccaatttccaggcccagctcaatttgtgctgctccataactctttcttgacctatccaggccaccaggtcatacccaagtttataaattcctcctggtctgtaccacttactttaactgttaatcctatgatacctcgcattgttaaatatttgagactctaattccattgcccagtgaccatgtctcccatttcttctgtctttcagagtcatccagcacacctattgctacatagtttttattgttaaaatatttaatagctgtaggccgggcgcagtggctcacgcctgtaatcccagcactttgggaggccgaggtgggtgggtcacctgaggtctggagtttgagaccagcctggccaacatggtgaaatcccatctctactaaaaatacaaaaaattagccaggcgcggtggcatgtgcctgtaatcccagctacttgggagattgaggcaggagaattgcttgaacccagggtgggggagattgcagtgagccaagatcatgccattgcacaccagcctgggcaacaagagcaaaactccgtctcaaaaaaaaaaaaaaaaaatatatatatatatatatatatatattatagctgtaacgtattttatcaaataggtaaatggttttgactcttcatgaattattggatgggttgtttccagattttagctagcatggcaaacactgtagataacaaatgcttagatttaatgttagtttagttttgttttgttttccttttgaagcattcccttggcctaataatgatagttttggaataaccttgctgaggattttacgtagggaagatattatgatcttcctttcctattttaagaagctgaggttcagagaggtaggtaaattgcttcagatcacatagcccgtaagcagaggagtcaggtttcaaatctagcctactagatcacaactctggagcacttaacctccgtgccacactggccttggcccaagcaccactccctaccactcactttgttggccttgcctctccaaggaacaggtaggcctccttatgtgtaaggatgaaggagagaccattattccatatgtttctatcctgctagtgtcaactcctgcccggtgtccaaggtgcccatgcagaccagatctgacttgtttctctttactccttaacacccagcacatagcctctctccctagggcatgatttctcttactgtcttccatgtgtaaaagtgaccgtattgtatttctttctgttaagggcaagttcttttttgtgtgttttttttcttttgttttgtttttttgagacagggtcttgttctgtcgcccaggctggagtgcagcactggcacgatcatagctcactgcagcctcaacctcctgggcccaagtaatcctcctacttcagcctcccaagtagctgggactacaggtgcatgcgccaccacacccagctatctgttttttatttttaatagagatggggtctcactatgttgcccaggctggtctcaaactcctggggtcaacaatctgcctgccttggcttctcaaagcgttgggattacaggtgtgagctacagcactcagcaaaggctcaactttcatctagatgccattaggccagaatcaataacctccctcaaattacgtgacacatgattaatatgctatcactccaggactttttgcacataaggctaaatgtaattgcttcatctcttcacaaccatgaaggcaacgtcttcatgaaggcaagttaagagaaagagggtggtcacaagatgatgttttctcctgaaacagtggctactcccactggctgaaaatagaaaggctagagcaagacggccaaacagacccctccagcgattgtctccatgcaggaacaccaaactgaacaactgtccccacaaggaaagcacctttaggccggatgcggtggctcacgtcagtaatcccagaactttgggaggctaaattgggcaaatcacttgaagtcaagagttcaagactggcctggccaacatggagaaaccccatctctactaaaaatacaaaaattagctgggcgtggtggtgggggcctataatcccagctacttgggaggctgaggcagaagaattgcttgaacctgggaagcagaggttgcagtgagacgaaatggtgccactgcgctccagcctgggtgacagagtgagactccttatttaaaaaaaaaaaaaaagcatcttcataagaaacaaaaaatcaggtgagtgatcacagtacctggttttcacatcgtatcaagaagaggcactgaagagggtgggaaagacggtcctgcatcgcctatgcccccctccctcacctctggcacaacagcttggagagagaatctgtgcatgtggtggagcgagaggagtgtgggattttgcattggaactcactgctgccctgtcacagcacagcactacactgagcagaattctgctggcacccacagaggacacatttagatcagctctgggccagaggagaatcctcaggtagagtgggacagacctgagtcccagctggttctgccaccagctgaccaaagtggcctggggccctgaatacatatgagtgacagtcaggtcacaaggactatattccttaggcaaaccctggagatgcactggtcatggaggcagtggactttgggtgtgtgtgaccgcgtgtgacaccaactgtggtgaacaagggagtgcctgcatcattcctcccccaactccagacagggcagctcagggagagactcctacttggggaaaggagagggaagagtactcaagttgcaagacaaagtccagaagactttgagtagcagctcagccacaggaaaataaagcaccaggcagaatcctgaggctcctgattccaggcctttgctcctaagctacatttccagacctaccctgcgccagaagggaatccactgctctgatgggtcagatttatcctggcaggattccccacctgctgactaaagtgcccttgggctttgagtaaatatcagtggtagctaagcagttctggccacaggccttgggcaggatccaatactgtactggtctgcaaagcttcaggtgtgacccagtgcactgccatctgtggtggccatgggagtgctcatgtcacccttccccccaactccagacagcccagtggggagagagattcctgactgggggaaagagaagagacaaagtgagagatgttgcctgggtaaccggggaattttcccttatcttacccaaggccaccaaagatacaggagtatccaggagttggcaacagttgcaggggtcataggcttagggcaccccctggtatacatcagctgcagagaccgtaggcttaagtcacagcacttaatcccctttgaatatatagaaagccttctcaaggaggatgggtacaaataagtccagactgtaaagacttggaataaatacctaactcttcaatgtccagacattgatgaccatccacaagcatcaagaacatccaggaaaacattatttcaccaaatggactaaataaggcaccagtgaccaatccaggagtgacagagatatgtgacctttccagacagggaattcaaaatagtagtcttgaagaagctcaaacttcgagataacaccgagaagaaattcagaattctatcagaaatttcaaaaagagattgaaataacaaaaatcaagcagaaaggctgctctgcctatggagtagccattcttttgtttctttacttctctaataaacttgctttcacttcgcaaaagaaaaaaaatcaagcatcacttctagagctgaaaaattaagttgactaaaaaatgcattggagtctctcaacagcagaattggtcaagcagaagaaagaattggtgagcttgaagacaggttatatgaaaatacacagtcagggccaggcaggatggctcatgcctgtaatcctagcactttgggaggccaaggcaggtggatcacctgagatcaggggttcgagaccagcccggccaacatggcgaaaccccatctctactacaaatacaaaaaattagccagtcatggtggcaggtgcctgtaatcccagctacttgggaggctgaggcaggagagttccttgaacctgacaggcagaggttgccaccgtactccagcctgggtaacaggggcaaaactccatctcaaaaaaaaaaaaaaaaaaaaaaaaggagtgatttaggatgtccccagataaatgccctttagcctgtgacgtaaagaatctttagttacaatgcaaacatcccagaaagaataccatattaccattatcaattattagaaattcttaaggaggctatgcgcggtggctcatgcctgtaatcccaacactttgggaggctgaggtgggcagatcacctgaggtcaggagtttgaaatcagtctggccaacatggcgaagccccatctctactaaaaatacaaaaaattagcgggtgtggtggtgggcatccgtaatcccagctactcaggaggctgaggcagaatcgcttgaagctgggaggcggaggttgcagtgagccaagatcgcgccactggactccagcctggacgacaagagcgaaacttcatctcaaaaaaaaaaaaaaaaaaaaaacttaaggaatagttattatctgatatgatggcttattaagaaggaagggaacacatgataggtctgttttgaaaaggaatggggacagaacaaaatattactaggtctgatcaaaagaggcttgttctggcttgtctttgtctgccttggagtcacgggacaggtgtaaggccaaattgtgcacttcccagtcatgttaccttgggcaaataatttaaaatctgtagtttcccaatctgaaaattgagtctgatacctgttctaatttagtgttgattgatatgaagctcaaaatcagaaacatgtatgaaagttctttgcaaactaaaatatatgtgtgaggaattgttattattagtttagaggatggactgttgtccttagaaggcaagtctctgggtcctacagttagatgcactgagcgcttcgggaagaatttagggctatggggtactcagcaattaaaagagagggtgcttagagaaggaagaaaggacttattaatggagtttggaggctccttattattgaaacttacacattacgtgaccagcattatgaggcagcacccacttccaacaaatagccctctagaaccaaaagcagagtggcaggtcctgggtccttttgtacacagcataaaaaattaagtcaatcggccaggcgtggtggatcatgcgtgtaatcccagcactttgggaggctgaggcgtgtggatcatctgaggttaggagttcaagaccagcttgaccaacatggtgaaactccgtctctactaaaaatacaaaaaattagccaggcgcagtggtacatgtctgtaatcccagctacttgggaggctaagacaggagaattgcttgaacccaggagtcggaggttgcagtgagccaagctcgtgccactgcactccagcctgggcaacagagtgagactctgtctcaaaaaaaaaaaaaaaaaaaaaaattaagtcaatcctggcataactgcagaccaggccctggaatgagcaacccaccagcattatctgcatttctaggaacttgggctagaaggggaggaatggggttggaagggttaggctacatgcctctagttaaaacctgatgaacttcctagatccccaactagaaaatgtaggagttggactaaattcctctcctgcctctaatattttatgaatacagaactcaactcaaaatgggtagtatctcagagattccaaatttagttctacttttctgtttgcttatcagtcgcttaccctcaccctctggtctgatacctttatcctgtacaagtggtcaaagtaggttgagtaacgtgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaactttttttgtagagacagggtcttactatgttgtccaggctggtttcaaactcctggaatcaagcgatcttcctgccttggcctccagaaatgctgggactgcgcctggaatagatacgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaatttctcaccatgcactcacacagctatacagctgtctccagagattactctggaaactctgctataaagatgacctggtctaatgccttgatttgttttttgtttgtttgtttttttgagacagggtctcactctcctggagtacagtggcgtgatcatggctcactgcagccttgacctcctgggctcaagcaatcctcccacatagctgggagcataggcacatagcacaccactctcggttaaatttttttttttttttttttttttttgtagagatagagtctcaccatgttgttcaggctggtcttgaactcctggactcaaacgatcctcccaccttggcctcccaaaatgctaggaatacaggcatgagccactgcaccaggcctaatgtcctgattttataaatcccaaaactggggcccagagaggagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctacaaggcagtcctcagagagaagcaaggttctgcatcttaaaccttccttggtttcttaggttccaaagctgtttctatcagtctccaagcaaccaactctttagaattccatgagtctactcagagaacttgtgggttcagtcgggggtatatcttcaaccatttattaaatttccttctttgtaaactgagctgtgagaaattgcatcttatttattgattatttattgaatggtagtttcatggagtttttcgtctttttttttttttttgcgagggagtctcactctgtcgcccaggctggagtgcagtggtgtgatcttggctcactgcaacctctgcctcccaggttcaagcaattctcctgtctcagcctcccattacaggccacaccaccacgccccactaattgttgtacttttagtagagatggggtttcaccatattggccaggctgttctcgaactcctgacctcaagtgatgcacctgccttggcctcccaaagtgctgggatttgcaactgtgagccaccacacccagcctcttggtcattctttgaaaaataaacctcagccaggcgcaatggctgacacctgtaatcccagcaacttgggaggctgaggtggcggatcacctgaggtcaggagttcgagaccagcctgaccaacatggtgaaaccccatctctactaaaaatagaaaatttaaaaagaaaatcagctgggcctggtggcgcatgcctgtaatcccagctacttgggaggctgaggcaggagaatcgcctggacccaggaagcagaggttgcagtgagccaagatcaggccattgcactccagcctgggcagcaagagtgaagtgcagtctcaaaaaataaaaataaaaaaaccctctagatgtatgcggctccatattctcccaccacaagggtttataaatcctgagaaagaggcaaagcagggaacacatgaccacatagctctggcaggcgtcagattaccaggctgataaaacagatggtaaagtagaagctgtccgttgacttttccattcccctttcagctcctccactgctacttaatctcctttgcccacacagttcaatcctattttccctgatctccaaatcctggctagattattagccattaacactagcttttacaaggagactcttcaatcttgtatttctagtagtataatttcacacgtacagaaattctttaagtcatagaagtcttacagatacagaaattctgatcttcaggagtcctgttgtgaaacaaactaatttatcctgacagcaggaaagatttctgggcctaaggctctgtctcgttgacccagctcatgctattcaggtggtccatctcttggttccaggcaagactgctgctgctgaccaacctgaatatggactttagcacttgggctcaagctgcactcagatggttggaccaccataaaagagcgagagggtacgtttttggtatgaaaagtaaagactaggccgggtgcagtggctcacgctcataatcctagcactttgggaggccaaggtgggcagatcacaaggtcaggagattgaaaccatcctagctaacacagtaaaaccccatctctactaaaacatacaaaaaaattagccgggtgtggtggtgggcacctgtagtcccagctacttggaggctgaggcaggagaatggcgtgaacccaggtggtggagctttcagtgagccaagattgggccactgcactccagcctgggtgacagagcaagactccatctcaaaaaaataaataaataaataaaaagaaaagaaaagtaaagactaaaaaaattaaatattataaccctgctaaggcaggaggatcctttgagcccaggagtttgaggctgcagtgagctatgatggcactactgcaacccagcctcagtgacagagggagaccctgtttctaataaaataaatcaaaaccctgttgaaggttcctcaaaaaattaaatatagaattactatgtgatccagcaattctacttctgggtacatatccaaaagaattgaaagcagggactttaacagatatttgtatacccatgttcatagcagcatactcacaatagccaaacggtggaaagaacccaaatgtccatcagtgaatgaatggataaacaaaatgtggaagatacatacaacagaatgttattcagccttaaaaaggaatgaaatgggccaggcgtggtggctcaggcctgtaatcccagcactttgggaggccgaggagggtagatcacctgaggtcagaagttcaagaccagcctggtcaacatggtggaaccccatctctactaaaaatacaaaaattagctgggtgtcctggtacgcgcctgtagtcccagctacctgggaggctgaggcaggagaatcacttgatcccaggagacggaggtttcagtgagctgagaccgcgccactgcactccagcctggggggacagagcaagactccaaaagttctggaaatggataatggtgatagttgtacaacaatgtaatgtacttaatgtcactgacttgtacacttaaaaatggttaaaatgggcttgttccagcagctcatgcgtgtaattctagcgctttgagaggccaaggcaggatgatcacttgaggccagagttcgagaccagtctgggcaacatagcaagaccctgtctctaaaaaaaaaaaaaaaaaaaaaaggttaaaatgaggccatgcatgcctacaatcccagcactttgggaagatgaggtggtagggtcacttgtttgggaagaggaggtgggaggatcctttgaacccaggagttcaaggctgcaatgaaccatcatggtgccattgcactccagcctgggtgacagagcaagacctagtctctaaaaaataagagttaaggccagacacggtggctcatgcctctagtcccagcactttgggaggctgaagcaggcagattacaaggtcaggagtttgagaccagcctggccaacatggtgaaacctcgtctttactaaaaatacaaaaatcagctggccgtggtggcatgtgactgtaatcccagctactcaagaggctgaggcaggtgaatcactggaacccgggagccagaagttgcagtgagccgagatcagaccactgcactccagcctgggcgacagagcaagactctgtcttgaaaaaaaaaaaagaattaaaaaaagaaacatggccgagtgtagtggctcttgcctataatcccaacactcagggaggccaaggtgggaggattgcttaagcccaggagttcgagaccaggcaacatagggagaccccatctgtacaaataatctaaaaagttagccaggtgtggtggtgcatgcctgtggtcccaggtgctcgggaggctgaggtgggagaactgtctaagcctgggaggttgaggctgcagtgagctatgatcgcaccactgcactccagcctgggtaacacagtgagacaccccgtcttaaaaaacaaacaagcaaataaacaaatactatgcataaaacctcaaggctcaagaaacaacagtttgaaatagttagatgtgtgttttttttaattttcatgtcttatcttttctgcttttttttttttttttaagggatgaggtcttgctctgttgcccaagctggtatcgaattcctcctgggctcaagcaatctcctgcctaggcctcccccctaacagctggaactacaggcatctaccactgcattcagctactgggggagtgtttgactagtctttttaaaaaatatgttaatatcttggtaaaaagtatatttatactgttctctaacctgctttttttcatcagtttcatggaagaatgctcatcatatattcttctgctttataactaaactgctttcatttatgacatcacaattaaactggtaaaaccaaatttatattgctaacttgtttctaattttttctctattaaaatgatatgattagcatccttgtagccaaatatttacacatatttatgaagttatacttaaaacaaattcctagacgtggaactgtgagtcaaagagaagggatcttttaaatatttttgcatagattgccatgaaaaggtcataccagtttatatatccaccaatatgagtttcttttccaaatcttcttcaacatcctgtgagagacagttaaacatagttgttcagagcccagccttgagaatcagatttcaaacatatgaaccctctccctttttcttttctttttcttctttcttttttttttttttttttttttttttttttttttttttgcccaggctggagtgcagtggcgccatcttggctcactgcaagcactgcctccagggttcacgccattctcctgccccagcctcccgagtagctgggactacaggcgcctgccaccacgcccggcgaattttttgtatttttggtttttttttagtagagacggagtttcactgtgttagccaggatggtgtcgatctgctgacctcgtgatccacccgcctcggcctcccaaagtgctgggattacaggcgcgagccaccgcgcctggcccctttttcttgttagagacagggtcttatccaggttggtctgaaactcctggccttaagaaaccctgccacctcagcctccaagtaaactgggattataggcgtgagccacctcacccaacttccacttcccagctgtatgatcttcagaaaatcagttaaattctctgggccttaatttactactacggttcttgtaagtattaacaattagctactattatttaccttctttagttcctgagacttctatgcacagaatatacttgatgtgtgccacagaacctatacaaaggtaattacaactaacagggagttgtatgataatgacatgggacatgggacatgagagcatttggaaagagataaaaaggcttaccttgaggacagccttattaggagcagaggcaaacacaggttttgtgagtttgaagcttacgcatttataggtttctctaattaccaagataggaaattatgaaatcaggtacaagggcttgggaggggcctaaagcttaagtttgatgaaaaaaaaaaaccacctctggttggaaccaatagcctatgaaaaagtagaaaaaagcccaatgcatggggagcgccggtagtcccttgaggtgtttgagaggctgaggcaggaagatggctttagcccaggagtttgaggcttgtaagtgcgcagtgatggtaaaccgccgctgtactccagactggcaacgtagtgagaccctgtctctttaaaaaaaaaaaaaaaaaaaaaaaaagatgagaggtaacacttgcctgactgggacaaaaatgagaaaccagtataagaaaataataactattggccgggcgcggtggctcatcgcctgtaaatcccagcactttgggaggccgaggcgggcggatcacaaagtcaggagttcgagaaattaataactattacctcatttggctatttttacacctgtaaggaataaagctcagaggtcacacagctagtaagaagccagcacccttcgatgtgggagtgatgtggaggataggcatatacagagaacacgaaagcaaaacaccatggtgcagattttgaaagaaaagccctaagattagtaatgagtgtgaattattcaacaaagtgatcaaaaccaactccagtcctgcattcctcttcgccatcaggagtttggagcctggagactgctagctgcctggttgttgttgtttttttttttttctgagacggactttcgctctgtcgcccaggctgtagtgcagtggcatgatcttggccaactgcaagctccaccccccgggatcacgccattctcctgcctcagcctcccgagtagccgggacgaaccagtcctggcccagcccattccgcgagccagcaagcttctgaaaagcaaacctaggaagttgctttccaacataaagtggaggtttcaacacaggagactttaagcaagttccagtgtgtctatatttggtctggctgatcggctggactctggccttccccgctcacattagcagacagctctgccctagtgggcgtttagcctgcgacggcagcccgagaggaagagttgggcagagttgcaggggtctccacagctgaggcagtttggccggattatttgggttcctgctcggatggcggcgacgctgatcctggagcccgcgggccgctgctgctgggacgaaccggtgcgaatcgccgtgcgcggcctagccccggagcagccggtcacgctgcgcgcgtccctgcgcgacgagaagggcgcgcttttccaggcccacgcgcgctaccgcgccgacacccttggcgagctggacctggagcgcgcgcccgcgctgggcggcagcttcgcggggcttgagcccatggggctgctctgggccttggagcccgagaaacccttggtgcggctggtgaagcgcgacgtgcgaacgcccttggccgtggagctggaggtgctggatggccacgaccccgaccccgggcggctgctgtgccgggtgcggcacgagcgctacttcctcccgcccggggtgcggcgcgagccggtgcgcgcgggccgggtgcgaggcacgctcttcctgccgccaggtgactcacctccgctaattgttcccctctgcccatccctgttcctgcgctttccactgtgtgtgtgtgtgtgtccccttcgccccgccccgctcttttcgcttgtgtgtgtgtccctcctcccgccccaccaccaccaccccgggctatgttgcccaggtaggtcttgaactcctggacccaagctatcctcccgcctctgcctccccaagagctaggattgcagggtgagccactgcgcccggccctttgaggggagttacacttatttttttatttttattttttttcgtccctgcgcttttcatacggagaaaggatgtagcttccaacattccggaggttagtgtaaggagacaggaatggaatggaaagttggttggggaattgcccctgccgctccaaaactgagaggtccctcaaacctagtgctcagttaaaagacattgtaagggctgggcgcgctggctcacgcctgtaatcccagcactttgagaagccgaggcgggcggatcacgacgtcaggagatcaaggccatcctggctaacacggtgaaaactcgtctctactaaaaatacaaaaaattagccgggcgtggtagcgggcgcctgtcgtcccagctactcgggacgctgaggcagaagaatggcatgaacccaggaggcggagtttgcagtgagccaagatcgtgccacgcactccagcctgggcaatagagtgagactccgtctcaaaaaaaaaaaaaaaaaaaggcattgtaaggaaagagaaaagacacataatattaaaaacaaacaaaacaaaacaaaaaaaacaggccggacgcggtggctaacacctgtaatcctagcactttgggaggccgaggcaggcggatcaagagttcgagaccagcctggccaacatggtgaaaccccgtctctactaaaaatacaaaaattagccaggtgaggtggtgcacacctgtagtcccacctactcgggagtctgaggcaggagaatcgctggaaccctggaggcagaggttgcagtgagccgagatcacgccattgtactccagcctgggggacaagagtgaaactccatctaaaacaaaaacaaaaacaaaaaacaaacaacaacaacaaaaaattttcaagtagtttcaatgttcttatttatgtatggaccaggaagtcacttttttttttaataaaaagaattccaactggttttctcactgtatttccatggcagctaggaggtgccaggtggctgggcctgtgacagtgcagaggttttggtgcctgcccgcccaccattgctccagctgcagctgctgccccctgcagggcctgttcgttcctgctgcctagctccctgctggctggctatgatctccgtcctgttaccattccaggagagcagccacctccctgtgcatggcaggaccaggtactgattgtggcctctcctcttggcctcgaatggtatccttgtcatcagtgagcaagtccccaaagaccacggtcttgtccattgtcaggataattcactccacaagctgggactccaggtgctgctctacccagcggtgcttctcacccacacagtggtcatactttggcaggggctggtgcagtgtgaagacctcggtgttttgcatgtgcttcatctcttgcaaggccctctggggttgggcttcaagactagggaaaagcctagggcttcacacccatgggccactttatccaccaggtccggcagcagggtgaggtactgcttccagaccaggaagctgcggtgctgctgcagtgtcacatgcagctccctgagaagcggcggctgaagccccacaggatgccgtctggaagctgccagcacgcggtccctgtccatcagcacacgcgtgggctgtgctcatcgctgccggggcactggggtttctcgggatcctaggggtatggggcccagaaatgttctttaaaagtttctcatttttgcaacttttctttcaattcacacagtatgttaaggtttatgtaaattagcatttacaataggaaagcctcttcctgtcaaatggaaatttgaggttactggatacttttatattacataaagagcaatcagccagtgtagaaatgatgcttatccttattaataatcaaagaaatgcaaaataaaacaacagagtacatttcacaccctcagaagtggcccacttttagaagctagcattatcaattgctgaccagtatgtggaggaaatgaaactcactgctagaaggagtcaacatattcatctgctctgggcaacaatttgtcttaacttacaaagttaaatatgttattctacttgtacatgtgcaccaggaggcatattccttataagaggaaagccattgcagatgagcagtctggattaatttaaaaaaagagcaaagtcaactggaaacagtccaaatgtccatcaacaatagaacagattaataaattgaggtatatttccagcagtcaaagtgattgaactacagctagaagaatcaacatctatcaagatatacaaaagaaaagaaaaaaataaaaaagaatcaacatggatgaatctccaaaccactgttgagtgaaacagtcaaacactaggagaacacattcagtatcattccatttagatacagttcaaaaaataggcaaaataaaatattgtttaaggtacataatctaagtggtaatactatgaagaaaaccaagagtgatacacagaaagtccaggatactggaaagagaggaaagggcacaggggtctgtgggacgttgatggtttgcgggtatcagcactgaactatgtcttaaaagtgttgcctgtaaggtgtttgcattctttttttttttttttttttgagacagtgtctcgctctttcgcccaggctggagtagtggcacaatcttggctcactgcaacctccaactcccgggttcaagcgattctcctccctcagcctcccgagtagctgggattacaggtggccgccaccacacccagctaatttttgtatttttagtacagatggggtttcaccatgttggccaggctggtctcgaactcctgacctcaggtgatccacccgtctcagcctcccaaagtgctgggattacaggcgtgagccaccagacccagcctgcattattattctttaattttgtgtgaaacacaaaacctttaatgtaaatgataaaaatattcagtaagtggagtcattcagaatgagtagccttttgagtctgtctccattgaataagtgcattctgttgagtgcactggagaggaatttgtgctcttctatgtagcagtctttctttttgtttcttggtggtgcaccattaaatggattcattcaccagttaaaggacatttgggttgtttccagtctttggctacaatgaataaagtcactataaacacttgccagaagtttctggacgaacacaggttttcatttctcgtgggtagatacctaggagtgggattgctgggtcacatgtgtggtaagtatatgtttaacttggtaagaaaccatccaactgtttcaggaatagcttagttttgcattttgttttgtttcttcccaagaacctgggccctttcctggcattgtggacatgttcggaactggaggtggcctgctggagtatcgggctagtctgctggctgggaagggttttgctgtgatggctctggcttactataactatgaagacctccccaagaccatggagacgctccatctggagtactttgaagaagctgtgaactacttgctcagtcatcctgaggtgagttcttctctcagatttatgggctatgatgtatcaggtctcttcttaaatggtctgggttttcacagaagttagctcattcatgacagccattccctaccccaacacacactaccttttttagtcacttcttatagacagtttctttctttcttcttcttcttctttctttttttgagatggagtctcactctgttgccaggctggagtccagtggtgcgatcttggctcactgcaacctccacctcccaagttcaagtgattcttgtgccccagcctcccaagtagctgggattacaggcacctgccaacatgcctggataatttttgtattttcagtagagacggggtttcacaatatttgtcaggctggtcttgaattcctgacctcaaatgatccacctgccttggcctccccaggtgctggattacaggcatgagccactatgcctagcctaatttttgtattttttttttttagtagagatggggtttcgccatgttggccaggctggtctcaaactcctgacctcaagtgatctgcccacctcggcctcccagagtgctggaattacaggcatgagccaccacacctggcctcttatagacagtttctattcaattctatattactatatttcctgctagtaaagatatttgtagttggtattatgcaattttaaattccagtatgttttttctttctttttttttttttttttttaagacggagtcttgccgtgtcaacgaggctggagtgcagtggcatgatctcggcttactgcaacctccacctcccaggttcaagcgattctcctgcctcggcctcctgagtagctgggactacaggcgcatgccacttctgcctggctaatttttgtatttttagtagagacagggtttcaccatattggccaggctggtctcgaactcctgacctcaaatgatccacccgcctcagcctcccaaactgttgggattacaggcgtcagccaccacgcccggccatgagatgacgtacttgttgatgacgactcagtttagttatgacagtgggaatgggtggctcaggtgggagacagaaaaagatcatgggagataatgagattaaggaactgagaaaccagagtaattgatagatcttccacatggttatcaccaagagtggtgatggacaaattgtggaaaggaagagatagaggggaggtaaattcccaaagctgcaaatctgggtaaatggtagaacccagattcagactcaggttcaactaacttccagggtgggcacaactcaccatattccactgtttgtggagccattcttcttctttttcctttgtccctttctcaggtaaaaggtccaggagttgggctgcttggaatttccaaagggggtgagctctgcctttccatggcctctttcctgaagggcatcacggctgctgtcgtcatcaacggctctgtggccaatgttgggggaaccttacgctacaagggcgagaccctgccccctgtgggcgtcaacagaaatcgcatcaaggtgaccaaagatggctatgcagacattgtggatgtcctgaacagccctttggaaggacctgaccagaagagcttcattcctgtggaaagggcagagagcaccttcctgttcctggtaggtcaggatgaccacaactggaagagtgagttctatgctaatgaggcctgtaaacgcttgcaggcccatgggaggagaaagccccagatcatctgttacccagagacagggcactatattgagcctccttacttccccctgtgtcgggcttccctgcatgccttggtgggcagtcctattatctggggaggggagcccagggctcatgccatggctcaggtggatgcttggaaacaactccagactttcttccacaaacacttgggtggccacgaggggacaatcccatcaaaagtgtaaattttatttgatcatgtggcctctctgttgctaatctctcctggaaacatctgccacatttagtgtgtgtatgtgtattcattctttctcataacttcttaaagtttcttcccctcattattaaaatgaatttaccagtaagaatgagtttttaagatttttataaactgtatactttatcagtttgggaagggagtaactgtaggaaacacaagaagtggaaaaagtctcctcttcctatctcaacacacaactgataaggctttagttctgaaaggaaaagtgagtaacatcaattaacagtgtctggtacgtaaatggagttcaataattatttgctgaatgagtataagtgagccaggcgtggtggctcacacctgtaatcctagcactttgggaggccaaggtgcgcggattacttgaggtcaggagtttgagaccagcctggccaacatggtgaaaccccatctctactaaaaatacaaaaaattagccgggcgtggtggcgcatgcctgtagtcccagctactcaggaggctgacgcaggagaattgcttgaacccgggaggcagaggttgcaatgagctgagattgcactactgccctccagcctgggtaacacagcaagactatgcctcaaaaataaataaattaattaaataaataaatgattacctactgtggaagaaaagcacataatataaaaagtatatcagatttgagtttctcctttaagaatggaagttaacatcttgcctataaactgattactagttagatataaaactactaaaacttttcaaaaccaatacatatttagttctttgatatcttctccttggattaataaggattctcctagtgcaaataaattttatgttcctgtttatacatatggacctttaggatttaattgtttcaaaagctgataaaacattattgagatgaattacataagcgattttaacaatgacaaatgtgaaattcaataacaatttaggcttggcatggtggctcacacttgtaatgccagcactttgggaggccaacgctggtggattgcttgaacccaggagttcaagacaagcctgggcaacatggcaaaaccccgtctctacaaacaaataccagacattgtggcggatgcctgtagtcccagctactggggaggctgaggtgggagaactgcttgagccctggaggcagaggttgcagtgagccgagattgtgctactgcgctctagcctgggtgacagcaggatactgtctcaaaaaaaaaataaagaaaaagaaagacaatatttatatcacttgatataaatagttacacaataaacttgattttttcttaaaccttagttgtatttaaaagaaaaaaaaaaccttaatttattattattttctttccttttttttttttggaggcagggtctcattctgttgcccaggctggagtgcagtggcacagtcacggctcactgcagcctcaacctcgtaggtttaagctattctcccacctcggcctccctagcagctgagaccacacaggcacacaccaccatgcctggctaatttttaattttttgtacagatggggtctcccaatgttgcccaggctagtcctgaattactgagctcaaacaatcctcctgcctcagcctcccaaagtgctgaaattacaggtgtgagccaccgctgccagcttccggcaccttttttctaaaggaattcatggttttgtagcagtagaatataaccagatctacagtagagagatgataccctgagatgaagctacctcctgtgttactctgcaacccaggaatgcagctggtgccatgtctccaaacttccacaagaatgccagtgctgggcatggagccccatttagagtacacatgacctgaggctctgaaaactcttagagatgatgcaatctgggacagttgctcatagctggcctggccaagtcccaccccaagatgccaggccacaacacaaaatttcaagtcatattgttttatcttttcccttgcaattatatagtatatgactctcttagaaaagtgcaatagttaaaacttgttttagtagatgctagatcccaaacttgagtctgctgaagcccttttgagaccttagggaccctattctccattcttagaaattcaggctggtgaatattagattcaaaagcaccacagatgagccggtggttgtagaagtacatgcctgtaatcccagctacttggaggctgaggcagtagtagtattgcttaagcccaggagttcaagccagcctgggtaacatagtgggacaccatcttataaaaacaatttttttttgagacagtctcgctctgttgcccaggctagagtacaatggcttgatctcggctcactgcaacctccgcctcctgggttcacgtgattctcctgcctcagcctcccaagtagctgggattacaggcgcccaccaccacacccagctaaattttgtatttttagtagagatggggttttgccatgttggtcagctggtctcgaactcctgacctcaggtgatacacccggcttggcctcccaaagtgccaggattataggcgtgagccaccgcacttggcaaaaaaatgttttaataacatgaaaaattttaaaaagcaccacaagggttcagattacctatcagcctcttgacatttcgtattttttttttttttttgagacgagatctaactctcacccaggctagagtgcagtggcagtaacatgatctcagctcactacagtcttgatctccaaggctcaagtgatcctcccacctcagccccctgagtagctgggactgcagacacatgtcaccatggacagctaatttttgtatttttgcagagacaaggtttcaccatgttgtccaggctggtctcaaaactcctgggctcaagcagtctgtccatcttggcctaccaaactgcttggattataggcatgagcaaccgggcccagcctagttagtctttattagttatttgaaagacatttttcttttcactttcaacccatgcacactgtgaacactgtgaaatacacagaaaagttcattaaactaacatgctccataatgattcacttatttatttgaaaacagaggttgggtgcagtggcttatgcctgtaatcccagcactttgggaggccgaggcgggcagatcacctgaggtcaggagttctagaccagcctgaccaatatgatgaaaccctgtctctactaaaaatacaaaaattagccaggtgtggtggcatgtgcctgtaatcccagctacttgggaggctgagacaggagaatagcttgaacaaggaggcggaggttacagtgagccaagatcacgccactgtactccagcctaggcaacaagagcaaaactccgtctcaaaaaaagaaaaaagacccggtgcggtggcttacgcctgtaatcccagccctttgagaggccgaggtgagtggatcatgaggtcaggagcttgagaccagccaggccaacatggtaaaacgccatctctactgaaaatacaagtattagccgggcgtggtgctgggcgcctgtaatcccagctactccggaggctgtggcaggagaatcacttgaaaccggaaggcggaggttgcagagagccaagatcgtgccactgcacgccagcctgggcaaaagggcaaaacgctgtctcaaaaacaaaatagagatggggtctccctatgttgcccatgctggtcttaaactcctgggctcaggcaatcttcccaccttggcatctcccaaagtgctgggattacaggcaatcaccactgcacctggccatcatgaataattttaaagggaaccacaacataaccaatacccaagtccaatcggcatggtttttaaaagcatatttaaagtgtataacatggaccaggcacagtagctcacgcctgtaatcccatcactttgggaggccaaggtgggtggatcacttgaagtcaggagttcgagagcagcctagccaacatggtaaaactccatctctaccaaaaaatataaaaatttgccaggggtggtggtgtgcacctgtactcccaactacttggcaggctgaggtgggtgaatcgcttgaacctgggagtcggaggttgcagtgagccaagattgtgttactgcactccagcctggacaacagagtgagaccctgtctcaaaaaataaaataaaaataaagtgtacaaagagatggttgtggcgggttgtttttgtttttgttttaagagacaggctctggccaggctggagtgcagtggtgccatcatagctcattgtagcctcaaactcctgggggcccaacccatcctcccacttcagcctcctgagtagctgagactataggcacttgccaccatgcccagctaatttttaattttttgcagaaacagggtcttattatgttgcccaggctggtctcgaactcctggcctcaggtgagcctcctgtaatcagtagaagggtccagctgccagccacttgtaaaaagaagccaatataataagagtgaggtgtgataaagagagtgagttttattatccatgctagcaaggggagaagtgagtgtagttatttgcaaatatttccactcttcaatttgtggagggaatccaggagcttttgaagagagagtttggagtgcagaagaggcagcggaactaggagttgtcgggtggcgtgacctgctccactggcttgttttgaagtattgtttcatctggtgaaggagccagtgccatcattgtggctagaggtgtctggtccatatccagatccagtccctgaagctgaaggaaatatatgaccaggtaatggtgtgtacttaacaagcatctaggtaaatacatgtgcataaggcacggaagcacagaatgggaaaagaaagggcgtggaggttcagcacattctgagggtgtatttcaagatgaaaggaaactcatatgcagatggtctcagagttctatcttgagactcactgggggaggagaaaggggaaaggaaaaaaagtcttaaggtttgaggctaagctgctaacctgcttagttacactcccaccttggcctctcaaagtgctgggattataggcatgaaccactgtgccaacccaacatggtgttttgatatgtgtatattaacacactgtgaaaggattcacaggtaattaaccaggtaattccaggtaattaacctatccatcgcctcacatctttctctctctctctcttttttttttttctggtggtgaggacacttgtcttagtctgttcaactgcagtaacaaaatgtcttataccgggtaatttataaacaacagaaatgtattgctcacagttttggaggctaggaaatccaagatcaaggcaccagcagatctggtgtctgctgagggcctgttcctcatagatagcaccatcttgtgtcctacctagtggaaagagcaaggcagctctcttcaacctgttttataagggcaccaatcccattaatgagggttccaccctcatgacagtcacttcccaaatgcctcgtgatgtgtgtgtgtgtctgtgtgtgtgtgtatctcaggggcgtcaggcctcaatttcctcatctatacaatgggtataacaacaatcccatcttgttgggaggaattaacaatcatgcatcgagccctgggcctcaggcttcaatgtattagttattagagctaatcattatttaatgttttaaacacccccaggaagtagagaacattcctgtcacattctgcagaaaaagaaattgaggcaaggggcaaagccatttgccaaggtcatagatcctgcaagccaatggcaaggcaggatctgaacctggggcttcagatcctggggctttacctgattaaataccaagagagagtgctgagatttttttggtggtggacagtccctgaggcaagccatttttagagcatctgggccacttggggaattgaatctttaccagggcttcccacctcctgttgccccttctctgaaggtgacccccctcccacagtagcaccccaaccactcagaacccccaagccaccttctttgcacatgctgaagctaatattgccctccactccaccccaacatcagggaccctggcccaagcccttccctgggagcccttcctcctctcatgaggcctccttcccagcccctcagaacagcctcctttatgagagtggccaagatcccactgaaaccttccctatcaactttataaaattaatcaggggagaagggaggggcgaaatggaaatcagcccagcttgcagcacacacagcattggtcatgaggtcagctgctctctgacccacttgctcagagttgtttgctgcctgttgctccagagtctcatagaccctgtcacaaggtcatagttccccttcactgctcatagataacaactggaacattataaaacattaacttttccatttgagatattctttcaggtcctgcatagcaatgaaactgaggcaggataggtagctaagggagtgaccgtgttctcgggatgcagcgaccatggcacccatacagtcaacacagtgagcctcagcattcgcattgtcattgcgctcattcaagcaaagctgtcttcattagggaatttcccccatagacagcatgagcattttgattttacctgtcctcaaactgacattttgctcattataatagtagaagacagccctacatggagatgtaatatgctaatgagacatgtgacatatgaacaagcatgtacagctactgtgcatgtgcacacagaagaccacccggaacatgcttattagcaacacctcttcccaccaccttatgaataatcatgtaagactcccataaagggagtctccctactgccagtctctgctgtctcacccttatgagcagcctgccttgaaccctctctctcacagtatacagtccattctgcatgtaaatttcaaaatattcttcttcctttgcaataaattactctatgctgcacttctttgctgtgtgtctcttgtttaaattcttttaaaccaagaagacaagaaccgaggtgtcacatcagccgccaaagaaactgctgatgccagcctgaatgaaagaccccacaggaactcactcactaaagaatgcagtttttgctgggcgcggtggcatggctatagtcccagcactttgggagacagaggcgggccgatacgaggtcaggagttcgagaccagcctggccaacatagtgaaacaccgtctgtactaaaaatacaaaaattagccgagtgtggtggcatgtgcctgtagtcccagctacttggaggttgagaggctgaggcaggagaatcacttgaacctgggaggcacaggttacagtgagctgagatcgtgccattgcactccagcctgagtgacagtgtgagactccgtctcaaaaaaaaaaaaaagaatgcagtttccacctcctgaaaatttaatcccctttaccccaactagtcaatgagcccaattttctagccctttaccctccatgatccctttaaaaaccctgttacaggtagttagacatgagcagggaaggagagggcttttctccctcacccactaggaatgtcaggtggtggttgacagttatcacgttgcctctctaaactgaaaattcgcagttggtgccagagggccagagtgagacaagctcctgatgatccacaggtgttaacattaaagtgttaattgaatgcaggtgccagggagaagcaacttcctgggcacgtgcattaagagacaaaatggcaggccaggcgcggtggctcacgcctgtaatcccaacactttgggaggctgaggtggatgggtcacctgaggtcaggagttcgagaccagcctgaccaacatggtgaaacaccgtctctactaaaaatacacaaattagccgggtgtggtggtgcgcacctgtagtcccagctactcaggaggctgaggcaggagaatcgcttgaaccccaggaggccgaggttgcagtgagctgagaccacgccattacactccagcctgggcaacaagagtaaatctccgtcttaaaaaaaaaaaaaaaacagacaaaatggctatgtatgacctctccaggacactccactggaaaagggaagaaagcctcagatgggcacgtatacaacttcctacacacactgtgcatgctcacttccgaaaggtaaagagagcacagagcatgagggcagctcaccctcagagaagaatcatgagaaagaggcgagcctataaagtcctaggatcacagttaaacagggctcttgaccttcaggtgcccggtcaggtctcttccaagtgaactttcctttctttcatgtcctaaagactttttaaataaacttccactctgctctgaactcacctccgtctctttttctgccttatgcccctcagtcaaattctttcttctgaggaggcaagaactgaagttgctgtagacctgtacagattcgccaccagtaactcagacaccttccactggtaacaaccccagcccagaattcttcaaggagatggatttgagggtctcctcccatctccttgctaggtgccctgtgatcatgaagctctttctgtgctgcaaaccctgctgtctcagtgtaattggtctgtaacagcagagtgggcattctgcagcctcttccttgcccggggcctgttgggagcccccagcactgcctgtaccatcataaacccaccctggcccctttcccaggctccaagctcagaggaggcagaggcttcattctaaactacagcatcccctccctaatcctcatttgccttctccttctgagcttgggccccattttttgagaccctaccagcccccattcccacaatcccctgtgccgacacaaatcaacctccccatgtcccaaccactgtcaaccccaacttagaccagtgcatcccacagctattctagcaccccataaacactccagtgtcccccacttcctgatcccacaacaccttgggccctccagataacccgctgctccagcctggcagtttgtcaaccccctcacccagacccccaacacctcatgcctgtcttatgccatgagtctgaggcccctgacccctacacctcttgggtgccacccaggcctgtctgtgtgggcagctcccccaccagctcccttccatcccccatgggtcctatccagggtttccccgacccaagcacacactattcggcattcctgactcccactgttcctggctcacggcctggccaccttgtctcgctcatctgccatagcccctgcctggcccagcaggacaggcctaggtcagggcaaggacaggtcagcaccagggctggtgccccaccccgaaggacacaagcctcctgctcaggacactttctggggtcctgtgcctccccttcttctcccccaggtgccaagtccccactttttaatactatcgcattgaggctgggcatggtggctcacacctgtaatcccagcactttgggaggctgaggtgggcggattacctgggctcaggagttcaagaccagcctgggcaacatggtgagaccccatctctactaaaaatccaaaaaataattagctgggcttggtagcactcgcctgtaatcccagctacgggggaggctgaggcaggagaatcacttggaacccagaaggtagaggtccagtgagccgggatcgcgccactgcactccagcctaggcaactgaacaggactagatctccaaaaaaaattaaaataaaaaagtattatcacattgggtattaggtttgttaaataaaaattattgctgtggaggatacacttgaagggaatgaaaaaaagtataggagactattgttttgctttttttttgttttgtttttgagatagagtcttgctctgtcccccaggctggagtgcagcagcgcaatcttggcacactgcaacctctgcctcccaggttcaagcaattcttgtgcctcagcctccctagtagctgggattacaggcatgcactagcatgccccgctaaggccattgttttggactaggctctagcactaggccccaatagacaagactaaaaaccaaaatggcgtcacctgtgctaaagtttcacccaacctaaactgaagtgttacctggccttctgagaaatcaggagagaaataacagccaatttcccaaacatgccagttttgatctttaattatcatgacaatgaggttcccctctgctttaatctgtacacaaaagaattagccagctgggcatggtggcttactcatgtaatcacggcacttcgggagcccaaggcaggcagatcactagagaccaggagttggagaccagcctgcccaacatggtaaaaccctgtttctatgaaaaataaaaaaaattagcaggcatggtggtgggggcctgtaatcccagctactcaggagacagaggcaggagaagcgcttgaaccagagaggcagtggttgcagtgagccgagatattggattaggcagtcaaaaaaaccaagcaagcataaaaggtcaataagttgtaatcttgatagtaaaagtggaaaacttattataaatggaaagaaagttttgatttccttttttgtttgatgggcagtatgccatattatacccaaagttcgtttaaaaaatatttccatcaactatttttatttgaaataaatatttgaggtaagttaccaaggcagcttttttcctcaaaagtaacctgttcctctttggaatagcacattttaggggcatggttaatacctgagatttttactcagtaaatcctgatggttactatgtgtaaaatatctttaagtaggattgaaggcctctgtggggaataaaatattaccaaagtctataaaaataaattttacatgttctcctttatgacagagagcagcactggttctgctacttttaaaatgaataattgatttcttgataggtgtttgatatttcttccctcactgctgattcttagatagaaaccattctttatatttgatagactgttttcagaaaacccttatcaacaagtgtacaatacttatctgaaactatacgtttagaatggagcagtttaatactagatctcagaaatttgaaaaatagcaaagaagactggatttggaaagcatggtctacaattgcttgtcaaattctgaagctatgaagaataaatgtttcaactttggattatgaaaccccatttatgattttttaaataaacttgaaataaaaatgattaaactaaaaaaaaagaatgtagagggagagatcaatgtaaaaatttatttaaagaaatagtaacagagaactttctaaaactagagaaagatatgaatatacaggtataagaaggtcataaaacaccaagccaactcagcctcaataagactacctcaaggcatataataatcaaactctcaaaggtcaaggctaaaaaaggatcctaaaagcagcaagagaaaagaaggacatattaataacatcataaaggagctccaatatggctggtagcagacttctcagcagaaactttacaagcagagagtggggtgacaaagtgctgaagcaaaaaaacttccaatctagaatattatattcagcaaaaacagccttcaaacatgaaagagaaataaggatattcttagttaaaaaaaaaaaagtgagagattttgacatcagacctgtcttataagattcttgttaagaggagttcctcactggttgagtatgaatggtcaaatgaaaagaacattaatattctcctgccttgcatattcttctaaaacattttacattcctaacacatcagtgtgtccacatcttgcttctaaggcagggggcaatttgatcctaaacagttgaaaaatgggatgaggactcatttcatccccagatgactacctataaggagtgattggctaggtgggtggctcacgcctgtaatcccagcactttgggaggctgaggcgggtggatcacccaaggtcaggagttcgagaccagccagcctgatcaacatggagaaaccccatctctactaaaaatacaaaattagccaggcatggtggcacacacctgtaatcccagctacttgggaggctgaggcaggagagttgcttgaacctgacaagcagaggttgcagcgagccgagatcgtgccaccgcactccagcctggataacaagagcaaaactctatctcaaaaaaaaaggagtgatttagggtgtccacagataaatgccctttagcctttgacataaagaatctttagttacaatgcaaacatcccagaaagaataccatattaccattatcaattattagaaattcttaaggaggctgggtgcggtggctcacgcctgtaatcccaacactttgggaggctgaggcaggcagatcaccagaggtcagcagttcaagagcagcatggccaacatggcgaaaccccatctctactaaaaatacaaaaaattagccaggcatggtggcaggcacccgtaatcccagctactcaggaggctgaggcaggagaatcgcttgaacccaggaggcggaggttgcagtgagccaagatcacaccagtgcactccaggctgggtgacaagagtgaaacttcttctcaaaaaaaaaaaacaaaaaaaacttaaggaatagttattatcatccgatatgatggcttattaagaaggaagggaacacatgataggtctgttttgaaaaggaatggggacagaacaaaatgttacacaaggtctgatcaaaagaggcttgttctggcttgtctttgtctgtcttggagtcacgggacaggtgtaaggccaaattgtgcacttcccagtcatgttaccttgggcaaataatttgaaatctgtagtttcccaatctgaaaattgagtctgatacctgttctaatttagtgttgattgatatgaacctcaaaattagaaacgtatgaaagttctttgcaaactaaaatatatgtgtgaggaattgttattattagtttagaggatggactgttgtccttagaaggcaagtctctgggtcctacagttagatgcactgggcgcttcgggaagaatttagggctatggggtactcagcaattaaaagagagggtgcttagagaagaaagaaaggacttattaatggagtttggaggctccttattatcgaaacttacacattacgtgaccagcattatgaggcagcaccccactcccaacaaatagccctctagaaccaaaagcagagtggcaggtccggggtccttttgtacatagacggcataaaaaattgactaagtcaatcctggcataactgcagaccaggccctggaatgagcaacccaccagcattatctgcatttctaggaacttgggctagaaggggaggaatggggttggaagggttaggccacatgcctctagttaaaacctgatgaacttcctagatccccagctggaaaacgtaggagttggactaaattcctctcctgcctctaatattttatgaatacagaactcaactcaaactgggtagtatctcagagattccaaatttagttccacttttctgtttgcttatcagtcgcttaccctcaccctctggtctgatacctttatcctgtacaagtggtcaaagtaggttgagtaacatgtgctaaaaggagtaatatcttgcattctcccttgttattaaaatagaggaaactgccttgaaagaaaagactaaaaagcaataagccttagtatcagtatcttctgaaagctttaaaaaaataatactctcatctctaccaacagatttggattctgaagttctgaggtggagtccaagagtgtgcagtcagcttctggggtggtgtttgttagatacagttttttgtttatttatttatgtttgagacagggcctcactctgtcacccaagctggagtgcggtggcacagtcatggctcactgcagccttgcctcccaggctcaagcaatcctcctgcctcagcgtccccagtagctgggaccacaggtgtgcaccaccatgcctggctaatgttttaaaacttttttttgtagagacagggtcttactatgttgtccaggctggtttcaaactcctggaatcaagtgatcttcctgccttggcctccagaaatgctgggactatgcctggaatagatatgggtaaagaaccttttacatcagactcttgtgtcctactcccagaatgctgattcagtagcctgcaagtgaggcctagaaatctgcattttcacaagctctcaggtttaatacacaatacatttaaagaaagcacagcccaaagggtgtcagtggggtgtatgaaggaagcctggttagtggggagagtgggattagggaacagctgcttaacctggcttgtttcaagtccccctttctccctttttgccctcaaaaagttcccctcattttttcccctctactttctaattttttaccatgcactcacacagctatacagctatctccagagattactctggaaactctgctataaagatgacctggtctaatgccttgatttgtttttttttttttgagacagggtctcactctcctggagtacagtggcgtgatcatgactcactgcagccttgacctcctgggctcaagcaatcctcccacatagctgggagcataggcacatagcacaccactctcggttaaatttttttttttttttttttttttgtagagatagagtctcactatgttgctcaggctggtcttgaactcctggactcaaacagtcctcccaccttggcctcccaaaatgctgggaatacaggcatgagccactgcaccaggcctaatgtcctgattttataaatcccaaaactggggcccagagagaagagaaatcattaagatcaccatactgcttggtatctaaagtagtactgacccttttgacacctaatccaaagttttttcagctacctcaggttgcccctcatcttccagctgacaccatccagcacctttcagatactggcaaaggagcagtgtttcaaaattactttccaaatggcctcctaaaaggcagtcctcagagagaagcaaggttctgcatcttaagccttccttggtttcttaggttcc

SEQ ID NO: 987 - DNA, 195389 bp, Homo sapiens
ttctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcg

SEQ ID NO: 988 - DNA, 162815 bp, Homo sapiens
ttctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggagga

SEQ ID NO: 989 - DNA, 162921 bp, Homo sapiens
ttctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccg

SEQ ID NO: 990 - DNA, 166647 bp, Homo sapiens
ggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctccttttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattatactattgcctctttttcacaaatggatggtgctaaaatacgtgaaagtagtttattctcaattaatttaaaattcaccttgtacttctcttaatttgcttattagtgaatcctttctccatggataaactcctcaaaactgctgaagtatgtatgaggtattgtcctcacgttctggggggtataccatatgttccattaagatgtttgaagtattcacagaccttccccttctcccctattttacgtttgcttcccaaacttcattctatttttaaattttaattcctttatccatttttgcatcaatacttgtttaaaaatctattttactagttctattcgtgccattaaatgaacaaaagaagaaagcagaatttgattttaactaattacctaatcttgatgctttctgagtatacaatcagtagagatgaagtagaacaatcagatagaactaaattgtttgaacaaaattaagtaaaactaccagtgatttataaaactgtacccattaataacatgatatagtcttattttcaaaggattgaaaattaatggaagaaattttcctttccactagctttgcacgaaagaaataatcttctttgaatatcctcctgtaaatcccactgcaaattgtagtctgcacagaacagaatcgtgatgcctaatcctcctcttttcatggtttagtctatacaaagagcagagctggaaattggatcttttgacagcagttactaagcaacagaatttggatgtttttggttaacatcctaatatataatgtagctgatttgttgaagtttttgcatatattagctgagagaagtgggcactccggaagtgactacaggtccctgtatggctggggaggtgggcatttgttgttgttttgttcaatacactgtgtcttttggcatttgtatctctttggcgtagaaaggaggctggtgcagaactttcagaccttgtgactttttatattattaagaatacccttctctgtggctcacgatatgagaaaatgtaagattttttcctgaaaagcagggagaacaaataaaggattttaaggtcattccaggaagctttagagctttgccaaaagtttaggtccacttcctgaggcagtttcattagcagacagctaatgtttgcttggtctactcccaagttatttttagaaacgagattattactgatagcacccatttgaatttgctcatttacgtttttatatgctaccaaatatgattagagtatgcttttaactaatcgctgacagatttactgcattagggattttctaagctatgagattcctacagtcatcagatttctactaactaggtacttcacgccaagtacttcagaactgagatgaactctttcagctcccagaagaaccagagtgtttggctttgcttacctaagggcactaaggaggtcccagaggatggagggctgaatctcctgagagcatgcttgttgtggcttgtgatcccgaaaggctgggattaatggaactaatgctggtgtgctcccatttgcacttgtgtagactctggagcccgtagctgctgcccctgtcccacacacaggtggctccccagttgtctgaagatcccaggagtgggctctgggacttaagagcttgccgtgtccttgagcaccacattcagacctgcccctaatccctgcgtggcagagccccgcttctcctgtccctcagtgctcacggagtgcatgtggcacactcttgccttaagcccaggctccccacactctgggttgtctctcatacccctccagcctgtgtcgtacctccacctttgcatgcaagagaggttacagtttaatatgacaatctcattatgtgcacaggtggacataacgggcttctgtgttttctagagctgctcttccttcctttagagtagacttcccgttatttcatgagacacaggctgactgatgccactctttcccacattgtttccttcttcagttcttcctgttttttctttagccttctctttcagacttccctcctaactttaagaccctatatatgtatgttgataattttacctgttctacaggaaacttcataatagaactgggctgactatacattctttttctgtgtgtgtgtgaatatatactttttatttagccatttttgtttacaattgaaactctgggaattcaaaattaacatccttgcccgtgagcttcttatagacaccagaaaaagtttcaaccttgtgttccacattgttctgctgtgctttgtccaaatgaacctttatgagccggctgctatctagtttgacggggattctcttgcccacaatttcgcttgggaagaccaagtcctcaaggaaggcatcgtgcacagctgtcagagtacggctcctgggacacttttgcttattttttgtacggcttttttgagttggcttaggcagaattctcctctgagcgataaagacgacatgcttcccactgaactttttctccaattcgcgtactagccggacttggattttctggaaagatttcagttgaggaacgggaacaaagattatgatagctttccgaccaccaccaacttcagtttccttggctgccgtaatattcagctccctgagctgagccttgaggtccgagttcatctccagctccagaagagcctgggagatggccggactcgaactcgtccggcttctcgccattgggcttcacgatcttggcgctcgaactgaacatggctttctcctgggagaacttgcagcgcctgcttaggaagagacccaaatctcgcgagagcacgtcaaaatccctacattcttaagattaattttggggggagtctgtaagatacggttcttaccttcttacctccagcctcagtcctcctggcatcttctgtgttggggcatctttggatctagagcaagcactgtgtgacctgctgtgtgctataactcacggtgagtttggcacttcagttgtactagtctggctagggcagtttgtacaattttacttttctcgcatctttctttccagtacctctcctcctgctgggatttatctacctaaagttgtggtgcagcttcccggcttagtatgtaaatatctcacttggattttcctgtggcagctaacctcacgtacttgccagccaactctgagtatcttcttagtgagaattctgctggggcctgggccagaaagggtgaaagggactaagggactgaggagactaggcagaaatcgtggatcctgggaagagttatgagcacaggttacactagtgactagataaggaagaaaatgtacatgtgagaagagaaagggatgtgtgtgtatgtatgtatttaaattagagcagagtagctacccggaggagtttcagttgactggttacctgaaactagtcaagttacaactggaattgcacagccttcgtcatggtcggtgtgttaatagagcttgctgtgagtgcacctctccctctgatagtaattagcacagagaccgactgcaaaaaacaagaacgtcactacttgatattaagtgactgctgcaggtatttttcctctcaaatgttatgtgtaggccatgcagtcaactgtgaagtgatttggaatgctttgtgaattacagtgtctgagataagttggtgagactacataccatgtagcaagtcatcattagtttagacctaagcaatgtcctgagtaaggtccttgcagccatataagctgtacattgttttgagaaggaaaaacatagaactactgcaaccagccaggctgtggtgttccaggtccctgtggctctaatccatgatctcacagcctgatggtcagagttatatgctggcatcagagcttttagtagaattctgaaaaatgttttgaaaagcaaagcattattttcagtgattccttaaaattacctgagtttataagataccacattggctgcggttccatcttcaaaaaaagtagcaaagaaccgctgtagaactgcttctgagcttttcagttgtctcgaatgtaccaactcaaagccaaaaggaaccatcattgtgtatcaagagactgaaataaatatcctattctcattttctctttttctgtgtttggggaggagaagataaaaggcccttcccttcttgctctttaaatgtactcatgatccattttcaaaccagcttcacctctgtgttttatttcagttgccaaatcaggacagatccttgactccagttttctctttcatcaccacacccattcattcaccaagttctttcagttcctcctcctaaacatctctagattctgtccacttaccagcacacccactccctggccaccatcatttctcacctagaactccacaatctcaattaactattattcccctctaatgcttttctatacaatcaggaaaatgtttctaaaacataagcctgacatgtcagtccattgcttataaccctttagtggcttgttattgcctttacagtaaaattttaactcatgaaatttgtaagactctttacgtccaagttccttcatcacctcttctaattcatctcacctaccactccactgcattgacaccaacaccactttattttaattcttattgaccgttcctgcagtgttcctgaatgttcacatctctgtgtctcctaattttcagtatattctgcttagaacactttcttccaccctttccactggttaactgttgttcatgcttcaagtctcaggttaagtgtcacttcctaaatttaggaaactgtcctgactccctaagtccatttaagagtcaagataggctgagttatgctgcatgaaaggacaacccgaaaatctcagtggcttaacacaacaaagtttattttttatttacactactatatctccgtcatggctcagacagtgagttctgttcattatattttctcagagactcaagctaatagataatagaggccccgccttacatctgattccatgatagccaaggcagggaaaggagtatggtgaatcatgcagtgactcctaaggcttctttcagaaaggggtgtatttcccctcatatttcattaaccaaagcaagccccatagttatgcctaacttccaaggcactggggaaatactgcctaccctgtgcccccgtatcatcttgtatttcccctagcctaataatgtcatgctttgttataattacatgtgacttgcttccccaactctaacttttgtgaaagtaggattatttttgtcttatttattatcctctgcagtgccttcattaatgcttgatacataataagaattcaaaaatatttgttgagtgagtgaatgaataaggcagcactccaagactcaatccttaggcctttttttcttcttcttctgccatttcttcttgaagatggcttcctctgtcatggtttcagcagtcactgccctgagagtgatttccattccctgacttcaatcagatatctccaacttctcacttaatatttctacttgaatttaaaatgtgtaaatttattcttttagtaaatacttcttaattactctctaataaggcattatattaaatgatatgaggatacagaggtaattaagacagcacttgccatctgagggcttgcaatctagtataatacaaaaatagtacaatgaatcaataatatatatacgtaatatacaaaatcctgtgccaaaggagaagacaagtgatttatggcaagatggaattggaacttgtgttgtttcaaccattgaacctacagagcagacatcattactgaattctgttctgtgctgggcactacacataacatgaacagaataaagcttttatccacctcacagtccagtggggagacagatagcttaggacgaaaggatagatggggtttagacagagtgtgggagggtaattagggggtaaagggatggtgcataggaaaacgttttcaccagaggggttgacctgattaaatatctggagaaattgtcagtatttatgccaggaaagaggtaaggaaggaactgaatcaagatggtcacagtgagactctattatggtaacttaattgttaggaatactttaaaaaccaagtatacacaggttgtttttaaacctaacatgaaaaatggttaatatcatgagtttgactttatttctgtacctaattataagtcttcaatggttaaaagatacccaggaaggaatatatgccattccaagcaagatgttggtgcgggtggggatcgggtttactatcttggtgtactgaggttggttaccaaccagagagagtgggctgggatgcagaaactaattcttactcatgacactgatgagatttcctgagccccacctgtagtctctggaatagtaccttcatttccaaaaaggctagtctcaaggccttgagtacttctattcaacttgcagataagctaattcttctatctgatttgaaattactacatccttgccaggctaaaaccgttccttcactgcttaatttcattctcattttcttgaccatcttaagacagtgcattcatatcttttgtctggttttatacgtacatctatctgatccttcatactcaacctttaattcttttgtaagctcttttaccattatggtctgatttgagttgacagaattctgatctttcagtgttacttttgcttaacagagccacaattcttatagataataaaatggcatctagttttattttacacatctcttgtggctccatctagctcttgagtcattacactaaagtcctgctcctgacacagataccagagaccagtgtgatagaagtgatgggatgtgtcagttgattaatgatcagctagtccccagcctgcccaggtgtgacacacacagctgttagtgctgaaaacagccttagcctgctctctgttcagcggtgatccagtgtgtcaattctaatttattgtagtccaaagtgttggtgttttcctgtgctttgtttagtattgctcaagaagtaactaaacttcttggaaattgtcgtaactgtggaggacagtgagataataaatgactttgttttctttcagatctttgatgatgcgtacaaatcccagctcagttgtgtggttgtggatgacattgagagattgcttggtgagtcctaacttctgctgttgtattatctttgccacattacagctaatatctcaaaagttacaagagaaaattaacaagtatttataaactgtaaagcaatagaaatacctttctttgtcttacaaggaaatataatgttctctcttaaatagctgacatcaatgatagtattcattttaatatgccctgtgactataacaccattataaactgctttcttgtaagggcccatgtctcattttgtatcttccagtgtgcccttgccatagtaaatgattagtaattttcattgatgagtatatctgttatttaggacctctgagctcagaaattcacttgtgaactttgacagaactaatgaaagaagggtttaggatcacagagaaatctgcaaattcactaaaacactaagggcagaagttgtaagctctctgcacctcagtttctgctcttacaaaacagagactataatccctctcttgcttatcccacagagtaattgtgaagacaaaaatgggataataaatcttgaaaaaattttgtaagttaaaagtgcagtatagtaatttttaaaatatgtattaaatatctcctgtgttgaagtgcactcctacagaatacaaacatgaagaagacttggtcctggcacttaactcataagaaataaactgcaaggaagggccagaaagttgttaattttatttcactgtaaaattaaatcagtctgacataaattcattacaacaatggctcaggaaggggtaatacactctattgaaatggaaacccacctggtgacttaataacatctgaaaatactacccagtgtctgaataatcccttcttctttaagctgtccataatggtgtagtcgtgatttcaagctaactgttcttactgcatttttcccatgattttcagacctgcttttggtcctctgttatttatttttttaagttttggcagtgtctgttataaagcaaagcaggtatatctgtgaggtctccataaattgatagtgggttttgggtctgctaggtttgatacatctcagcccagtttatgggatgatttctttaaaagcttttaggcacaaactcatagctctgtgtaaattcctttatcttaacacaattgaggtgtgtggtcatagcaacactaccatgtcaggaatgtgtgccctctgagtacatttcactggtatgaatagttatcatctgtgcatgcttgctcatttattcaataagcacttgctgagcccttcctcctctggtagaagtattagagtctcagaaaaagacgctgctgcctgtctttataacatatgttggcaaatgttaatgcaaagtagaatgtgccatgtattttggatattctgtttttttttttatttttattttccctcccactgttctcatcaggtggatagtctgaaaatggagggatcagttttgacctcagggggcctgcgagtagctctaagcccagggcagaggtgcatatgcagtatgcagagaaagctaagcaggtggcatttacgctgaatcttgaattattggtaaatgtttaacaggtcagatgttctcttagaaagttatctgttccttaccatctgagggccaatcttagtggttctgccattgtttccgttttattgaaattccttattttcccctttgcccattttctaacatcatgttttaatatcagtgtactgaatggccatggtttgcagtaacttcttagaaatgcttggtaaatacacctggaatttttttttccttccaaaataatcccagaaaaaacatctacatgaactcaaagtgaatatttagaagctttttcaaaaaatttatagagccgagtacagtgggattatggcaacctataatcccagctacctgggaggcttaggcaggagggttgcttgagcccaggagttcaagacaagcctgggcaacatagcaagaccctgtctcaaaaaaaaagttacagataagagttcttatattttaagcatttaggttattagagatattttttcttattataaatagttttatgactgttatttaagactgtttactctttaaattttttttttcttattctatacatattctgcttatgtagggactgtgtttacttttgatgcaaaaaaaaaaaacaaaaactgaatgtttggaatatgtacatgtgtatcaaatccctaaacataataatgtttcttttccagattacgtccctattggccctcgattttcaaatcttgtattacaggctcttctcgttttactgaaaaaggcacctcctcaggtaaaataatactactaataaggaatattttaacaaagagtttttcagtaaatcgcatataatgatacaatctttaaataagcaggttatcataaacataaaattctgttgttgaaaggattttgaaaggtcgtccagtcttgacttctgtttaaggtaaattattttatcaacagaatttttccattccttttctgaagaaatcaaaatcccacagtttctgtgtggaatacaacaattagcattgtattttgttgttttgtaagttttccaccatattacatatccctactacctccaactgccaagggagattatgatattaatagagaaggcattgaatatgttcccatatgtttcatttataatttcatgggttttcctaaaaatttgtttatggggatatttaagtttattttctttgggcagttaaaaaactatttttaacagatgatcttgagttatttttcttgggtcatgtggcacttttgaggagtgaatttatagccaggatcttgattcctgtgtttgcatttttactgatgtggctattagagacttgtgattttggtaggttaacaaatttaaaaccaacctatgaaggttggttaaatatgttaattatgtagaggctgccagagcatgtttggctgtgtcacaagacatgagttctcttgattgattctgcatgctgtaaccttgaaaaatgccaatcaaaggcaggtacaaagcagttaagcactgacttgaaaagcatcttaatgtctgtatgagaatctcatatttaaagttagagatagaaactaatctgtaaggaaaatatttactcttaaactggtgaatctaatttttaatttaacagttatatatgtgcgtgtattttgcacttaaaagtaaatgacttgtcttggtttttctggagtttttttttaacttctaaaataatgaaaagaaacataacctataatagtcttgaagatttgcaacatatgtgtactgtggaaggatttttaaatcagcttttcataaaccatcattcctagtaattggagtcttagcttatactaagggtgaagttagagaggtgagtgtattttccctttctctgattcctgcaatattttcttaagtaagtaaacgtatatatctaaagttgctgaaacagaaataattatctacatatatcatgattcctccaatgttttcataaataagtaaacgtatatatctaaagttgctgaaacagaaataattacccccaacatctacatatattatgcacacaaaaaaactttatgtcagcatattaattataaaaactattagaatgtgagactttttctaggcatttaaatttatctcttaaaatagttcttcttttttagctgaaaataatttatgctaaaagtcacttgggagaaggaagattaacttcagtgctatcttatacttcttgttctttacattgttaaatactatacacattgatttaaacagaggtacacccccttggctgagaagcatttgtgatccaaagtagatactaacagaaataaacagaaactattaacgaatgatctgccacactaagatttaagaataattgtttctgtgttgtaaaacttattgtaagatttttgagggaaggaacattatcttatgcttttaaatctcacagccaatggcatagaggcttatacgtacatgcttcacaaataccttatcaacaaaaaaaaatttttcagtgtcttttcattttagtgggctcaagtgttttcatattgctggagtttatatttagacaggatatgataagagtgaaaacattcaaaaataagtaaagttcaaatggccaacaagtataagaagaggtactcaacatcattagtcatcagagaaatgcaagtcagaaccaatagtgagataccactcattgcatacctgctagaatggctatcatcaaaaagtcaggtaatgacaagcgctggtgcagatgtggagaaattggaacctgtatgcactgctggtaagaatgttcctcaaagaggttaagcatagagttaccatataacccagctattccaccaagtatacacctacaagcaatgaaaaacatatgtccacatgaaagcttgtatgtgagtattcatagcagcattattcataactaaacatttatctgataaaatctagtatatccatataatggaatattactcagcaataaaaaaaagtagtaccattacatactacaacatgaatgaactttgaaaacatgctaagcaaaaggagccagtcaaaaagaccacatattggatgattccagttacatgaaatgtccaggactggcagatctataaagacagaaaatatatttgggatggcctagggctgggaggggagaatgagaagagtgagagggtcactgctaatgggtatggggtttctttttggggtgatagaaatgctctaaaattgattttggtggtgttgtgtatatctgtgaatatactaaaatactgaattgtacactttaaatgggtaaactgtgtgctctgtgaaccatatctcaagcgattacattttttagaagtggtttaggagctacttaaatgatgaaaggagacatagagttagaagtgaggggtgagcatccaaggtacgtggcccagcttgggagaaagaggaattggatcatttaaaaagaacatggagtgaatttatctaaggactgaagaggaagaatatagaaatatgtaagaagtaagagatgtggttgccttagtgattggaaatggcaggggttctctctgaagggaataccatctggtcattaatctgaatttggtgactctgacctggactgccagattacctgcagtatacatgaatcagtgacaggataaattaatatttgtagtatttctagttggcatgtatttaacaaaataaaaatgtgctttgtcataccaccttgctttttaaaatgtttatattctctcaagaaaataaggggaaattttcaggctgatccaagtgttaagaatattagtcattgtaaaatggaagcattcactttgtcaaaccattagcatatagttttttcagatgtttttaattaaatattaaaggtatattcagctaaatattgtagaaatgcatagagtgatagaaaaatatttattactggtaagaaaacaaaagttgtgagcatttttctttaaaaggaggaactatacttatatacactacagtaatcatatcagtcacagaatcctcaattttgcatttgttgtatttccagctttcacacagaaaaattgtgtgtgcatgtgtgcacgtgctcaaataaaagaatcccttcaggggcactatgttgttatgtatccagatattctcttttctccttccacccctcccccaccaccccctcccttcttgtaaattggcttattaaaactggttcccaagccctccttttttccctttgtgattgccttggtcttggattttcagtgtagaactaaaaattcaagtcagatttcagttactaggataattttctttgaattttaaatttttctaagtaaatgcatagatttttaatgaacctggtattcagtggatttgctttaaatttagctgcagagttaatttcatgattgatttattagccctttgaaagtataaaaagtggtatctgcagttcgtgaagagtgaaaaacatcatcacattttgtttagcatctttttaaaaccaattaaaagcttttctaaaatggattgaacaggagaaaataaaacatgttccctaggtctttatttcaatcaagtttccctgtgttctgcaggagaagagatcgagaggggatagaaaaattgaaaagggctgtcccagcagggagccaagccggaaaaaagggcttctctgagaactcagcagcagcagctaagaaagctcccagcctgcttcatctacatgcagagtcacacaaggcatgggggtgctcactgtcacacagaggtttcacatgtgcttccctgctgattcctgtgaaaagctaacaattggcttggagggtaaaagaccactgcagttcaccctccctgagctggacgtacaatttgtccagtgttaggaaatgtccggcttagcagtgagaggcttgaagacacccctccttccagtgagattcctaacgccgtctcttttacttgatgacactggggctcttttcaagttttgcagatttatggaagttgaggggaatgtgcttttcaagatcaggaggatgaaagccttggtcttaatgtcaaggaggaagcggtagtgagtggtaaggccaggtaactcttcctgcagcctgcaggaccagtggcttgatttttcctcatagatctcttctgccaccttcttttttttttctttttgggagacagagtgtctgaaaaggaactccttgggctgtaaaatgacatgattccccagtttcctcaacaagtgtgagagtagttaagcctattaacctcactgtttaatgctgggtttgacacttttgtgcatcaaattggaaaacctcatctgtatgtaacagggtagcctcgtaatttatggaggagcaatccttcctcagttcagtgcttcccaacctttttagattatggtgcatacaaaatgataacatctgatgatacacttgggtaagtggatgaggccactcacaactggccagggctctagccttcccaacagctggcaggaattgatatcttagtccaggtataactcatttgaagctcaacgattggaaaactctttggaaactttaaacttttacaaaagaagaattaccactccaacgtcatagcagtattactgaagtagaactcagacctaacagttattagtgttctggctaaattttatgatgttgttgagaatagtaacttcctcgctgctctgacacctaggaatattacctaataagagagaaatacagcttaaagcttggaggacctaaggtgtggaccaataagaaactgtcagcattctcaggatggggacttgggtagacacacttgtttctgcatgagttttgtttttaacatcagcagtctctagacaacattgctttcatgtagtccttacatgacatcttagcagtcttacttcagatatggttataggacatcttggtatcttgataatattaagcaactctttaggctttgggttgctttagtgaaataagcagataatggaagagactccaaatcatgcaggcctaaacatgagtatctctccatctatttgttcaaaattaactctggctaatgactatgatatgactcaataagatatataaccactttaggaaagaggcttagtcattttgccagacacattaattttaatccactgatgtggtgacttttgcattgggcttcatttcttttatctaaaaaaaaaaatgatgcttgacagtttagtggcctgcttagtaagtcagtgacattagatacctactatatttataatattctctttaggtatactttgcttagtatagtagattttcttggaaagtcctttgtagattgaacatgtgtgtgtgtatatatacatatctctgaggacaaaggaaatttccagagatctgtgttcttgttttctggacagaaagataatgtatagtgaatgtatagtgatcaactaagataatgcctagtgaagccctttgtaaacctgtggactacatagatagacagtattaaagaacatatatatatagtacatatatatgtagattaatttcaaatgtatcaaaaacagtgaaataggccagacattgtggctcacgcctgtaatcctagcactttgagaggccaaggcaggaagattgcttaaggccaggagttcgagaccagcctaggcaacatagtaagaccagtctttacaaaaaaaagttagtcgaatgtggtggtgagcatccgtagacccagctattcaggaggctgaggcaggaggatcgcttgagcccatgagttcaagaccgcaggaagctgattcttaccaccgcactctagcctgagtgatagagcaagactctgtctctaaaaacaaaaccaacaaaaaacagtgaagtaaattattttataaaacattgctacagatatctgctgaataaaatcaaattttcaaaatagggttttgttttggttttggtagagcacatctatagtagatattaataccagaataaattataagatatatatgccattttctgataactcaaaattaaatatctaaattttaatcatcagagaaatgctaatagtgttgagacgaaatattttttcattgctagaatgtattcttccagatccattgccttaaataagttactgtggcattacattagcttttgaaaggtggggattataacgtcgtagtagtccatgggtgccatgactctagttaagagcaccctttctgtagaacttactctttgtattgaacttgaggtttaaaaaaaaaaaaaagaaacctatgtcttagctcagatatcatctggcattatagccttgaacgtcccttaatttcttggtgtctatttcttcatctgtaaaatagagataattcctcatgtgttacctactctgttgagggtcagctaagataatgtgtagtgaagccctttgtaaactggtggactacatgagctgtccaggcgcagtggctcatgcctgtaatcccagcactttgggaggctgagacaggtggatcatttgaggtcaggagttcaaaaccagcatggccaacatagtgaaacccgatctctactaaaaatacaaaaattagctcaacgtggtggtgtgcacctgtaatcccagcgactcgggaagctgaggcaggagaattgcttgaacccaggaggcggagtttgcagtgagctgagattgtaccactgcactccatcctgggtggatggagtgagactctgtctcaaaaaaagaattgcctttggatagtccacagaaccttttcagcttgtaagataggaaaactgaagaacgtataataactgctatatagaggaagtttccataggaagtgagttcagagctcccactttggaatgcctgaacccaacttccctcatttgcagtactgggaaaagaaacctgcttccccatctctcattcactgaaatttagaagcttcctacatcctaagacaaatactcttgtctggggattagggattcctgttgtagaaagaagtaggaagtggagacaggaattgccaagatcagtaggccaccaccaggtcacacttgtcttcagcctccagggactggcccacctgcttcctttccctgccaccacctgttgcttgtggctgaagttccccttttctcctaactcatggtgcaacaaagtggtgcttcacagtttctttcctacctttctgtcccagaaacaagaatgcagatctttggagatttcctgtgtccttggggatctcacaatggccagaagccctggccctccctctactccttaccctgttaatcttggatggtaggattataggtgatttcttttttattttgctttattgtttcctgtactttatagattttctacaataagcatatgttactttgataatcaggaaaaaataaaaaatgtgtatacaattatttttaacttagcagtataactgtcaaaaattccttaattccattgctttggtactaatttgctgctaaccactagggttaaatgagactacctttgtatctaagcttgtctatgtataatatatttttaaccttgttctttttatgacttaagatttaattgaatatctgaaatatgctgtgggttttggagtaaaagtgtgcaagtgcctcctaactctcacagttgtcctgggaaacccacctggcacttggctcagtgccatgctccccatctaaacttaccatggttgaatgccagtgtgactaaagttgaccaaggtagatggtaacgattgtcttaagcttcattgaaaggagatcggaagtttctttttcaccaaaaatatttcttttgacatagaagtttaaaacatttctttaaggaacatctgcttttattagatgtacatttaagaaatccttctcagtatagagataaaaagatgaataagacattgtacctgccctcagatggctcatagtccaagaacactgttcaattgtgaagtttgtgcacaaggtgggcacaggtcaagtagcaaatgaaggttaacatccagcccacatgctgcccaccaaggagtccaccctggtttgggactgaatctgccctgagtaaggttaccagatttagcagataggaatataggatacttagttaaatttaaatttcagaaaaacatcacataattttttagcatcagcatatcccatattttggtcagacttatactcaggtatttctctagcaaccctaacgctgaacaagaggaagagggtgccttttagctcatacgaggtgctggggcttggggaaggaagcaagggtggccgcactcacccagatgattgcttttttctaatttgttcacctagggtgtgtgtgcgtgtgtgtgtgtgtgtgtgtgtgtgtgtgttttctgatccatgcagaagctaactggtgtccctgtcacaatccagggtgggagaaagatgtgaaaacatgatgcatagagttaggttttatatgttacgtggttccagtggaacataaaggaaagtgtggtccattttacctgagaagatgtgcaaatcattcacaaatagtagtttcggatcctggtcttgaaagatgagtaaaagggagatttagtcagggccattgtgccatgctaaggaattcaagcgctgcagcaatggagagagaaggtgaaggatttatgtatgctaaaattagcatattattattattattattattattagagataggatcttgctgtgttgcccagggtggagtgcagtgacgcagtctcaatcactgcagcctttacctcctgggctcaattgatcctcccgcctcagcccctggagtagctgggacaacaggtgcacaccaccacacctgactaatctttatattttttgtatagacagggttttgccatgttacccaggctggtctcaaactcctgggctcaagcagtccacccacctcagcttcccagagtgctgggattacaggtgtgagccattacacccagcctaaatttttttaattaacgtacaatatgatacttgagaatttgaggatatgttctgtgtacttatcttaggcttcatatggcatagtttcactggagggaagaatagaaattcataagaaattataggcttcattttttctaagtgactgaagcttaacctctttaaatatcaattattatactttagccttttttaagaggaaaaaaattgctacatacattcttagtgtctgaagcaaagtataataaactctatgttaatgaataaggaccatcataacaaaccataattgatgggtcagtattttcatgggtgggactcagcaggaactgttggaatatacaggattccgtcctggtgcctgttaggtagatacggtgtgccctgtttgttgagttttttgtaccttttctttttttagtggttttgctatcagctgttacttgcagaatccaagtgagttgtgtcagctggcctgcctctgatgactcctttttccagtgtgctgctttcatctgctataaattaaggcaggcaaccaccaggattcatgagctgttcatacagtaagagaactaaactgtggttgggcgcagtggcttacgcctataatcccagcactttgggaggccaaggcaggaggatcacttgagtccaggacttctagaccagcctgggcaatatggcaaaaccccatctctactaaaaatacaaaaaagtccaggcacggtggctcacacccgtaatcccagcactttgggaggccaaggcaggaggatcgcttgagtccaggacttctagaccagcctgggcaatatggcaaaaccccatctctactaaaaatacaaaaaagtccaggcacggtggctcacacccgtaatcccagcactttgggaggccaaggtaggtggatcattcaaggtcaggagttcgagaccagcctggccagtatggtgaaacccccgcctctactaaaaatacaaaaattagccaggcatggtgacaggcgtctgtagtcccagctactcaggaggctgaggcaggagaatcgcttgaacccaggaggtggaggttgcagcgagccgagatcgcgccactgcactccagcctgggcaacagagcgagactctgtctcaaaaaaaaaaaaaaaaaaaaaaagccaagcatggtggtgcacacctgtaattccagctactcgggaggctgaagtgggagaatcacctgagcccaggaggtcgaggctgcagtgagtggagatcatgcaactgcactccagcctgggcaaccagagtgagaccttgtctcgaaaaaaacacaaaaacataaaactgggctgcagtgagagctggagaggccttccagagagcaaggccccattttgactcctgtgggccccttcctctactaaaaaaaaaaataaattttccacctgttggtacaaagctgaatatattactatattaatattttcttccaccaaaaagttctttttttctgatttttttttttccaggagtgcagtggcgcgatctcaactcactgcaacctctgcctcccgggttcaagcaattctcatgcctcagcctcccaagtagctgggactacaggcgcacaccaccacacccagataattttttgtatttttagcagagatgaggtttcaccatattggccagactggtctcaaactcctggcctcaagtgatccgccctcctcagcctcccaaagtgctgggattacaggcctggcctgattttaaaagaaattagaataatactttcatgggttcctcaaagtttcataggccctgggcactgtgtctagtgggtaagttgtccttgcctgtcagttttaaagttacttgaacctcacattgttttttcagtactaggagtgagaggatttttgcttatttctggttcttggctgtgctctggatagttgaaattgtttagcagattggcctccagataagtaaggcattattattggatatagtaaattcatgttctggaagtttggggcctaaaggagcaatgtgggctctgtagggttaaatgagggcagggtatggtgagaaggcaaattttgaaacattgtgaacataagagacaattgcaaattggcagaaaactggagaaagcattttaataaacaaatgctatggataaaaatcacagaggtaaaaattaaattagaaaggagaatattgacctgattagaacacaggggtcaatttagggtatatcaagctaaaagctgagataggtagggaaaatctactgtggatataagagtggggagtttggatttgctgattaatgtgtggtcatcttagttaagtttctaatgagagagcatgcacagaacccttcctttaaggtattaagaatactatggcatggtcagtacaactttatctttttctttttttttttttttggacaccaagttttgctcttgttgcctgggctggagtacaatggcacgatttcggctcactgcaacctccgcctcctgggtaagagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgtctcaatatcttcttaatttatttaaccttttctcctaagagcacagaggtcattatttctaggtaataaatctccctaactcaaattaagagatcagccattgctgatatggggcttgtgggggcaggggcaagagtggaccccaaatctagtttaaaattacacaaataaaaacagtagacagcaaagcatagtgaaaatagcaatgaggcctgaactgtagtttcagctccctcactggacatgagagcctcagacagatcactttacctctcaccccaggtttctcatctgcaaaatgagacagagaatgagggggtttgggggaatgaggtaatctttaagagctgctcccaatgtaaaatctgatgattcagtgtctttttcacaaattggaattagatatcctttaatatcatgaagtctgcttttgcctatagtattttaaattattaagggttcagtttctcgtttcatattcagtctgtatcatgaattcccccccttattgtcttctgtcctgcttgcagcaccatgaggatggttacaaagaagtagactaagaatttgcttcagggtaaaatctaatggagagtttaagtgtagttgcctgcctagttgtggcatgatttatttgaaacatccttcctttggtattcagcttaaacatttaactgcaaaaaaaaaagaaaagaaaaagttacaggcatttaaacaagagaaatcagaaatgcatgcaaagaggcccaattcctctcccttcacttgtctctggttgcttttaatggtagtcgatcttttcccttggtttggggaaaccaagagttgtaggagatgttaatagtacttggtttttgtttttgttgttgttgttgttttgagatgttttgctcttgttgcccaggctggagtgcagtggcgccatctcggctcactgcaacctccgcctcccaggttcaagcgttctcctgcctcagcctccttagtagctgggattacaggcatgtgccaccacgcctggctaatttagtagagacagcatttcaccatgttggtcaggctagtctccaactcctgacctcgtgatccacccgcctcggcctcccaaagtgttgagattataggtgtgagccactgcactggccaatagtacttgttatctcactagcttaggttaatgacagctaatgaatcttatctttcctctgctagagaagtctgtgttatccagtcaatagctaatcaattgattaaaagagataagccagactttggcacgaagcatacatgccgttcattctagattattttctttaaaatttgttgctatcaacacttggggctcagaggtgtagactctgaaatgatagttactttccttttggacacttaatataatgtgcatttttctaggaccagaaagtaataatgaaggagtgatctgctacccttgaaagctatactgggattatcattcattcagtgcatatttattaactttgtactttgtacaaggcagtatgctagccctggaaacatcagtaaagccaaaccgacttaagtcctgtcctgatgaaggagaactagcaagaaatacagtaaatatagtaagtatatagtatgtaaaaggcgatccaaactggaggagggaaagggcaggataagggttggggagttgcagttttaaatggaggtatgtggggattgagttggcctgtggaaaagctgacattcaggcaggtccttgacttggagggaaaggcctgtgtggctatggaagggaagagcattccaggcagaggaatcctctctgtgtgccaggcatgccatgctgagtactgcaagggcgcagatggatgatacgtggtttctaccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgactccctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagatgcttgcttcttttccttcttgcctgttctgactgtgatgacagagaccccgcctcaggaatctccacctcacactctattctcataagtaggtagaattttctcatcgcatatttatggttgaggaggagatagatgctgagaagttaaataatctaccccaaatcacacagctgtgagtgatggggcctctacttctgttgcaccaagctacctgtccatcaggggacttgcctcaccattgctttctgccagccctgggcttgccttaaaaaggacatcatatgcataagacactggttaaaaggtgcagcatggtccctggagatgctcactcttacaactggcctgtccttggggcagcagctcctcacaggcccctaagaggtagacctcctgcctgtggctgccagaaccctcttctccatcacaggtcttcctcctcaagagccttctctggtttcctgttgctttttatattaaatatttcccttagtttagcatcccgagtctgccttttgctgattgttccctccctgtgtctgcagacaacttcgttttcagccttggtgctctgtctcagctgcttctaccacacacataggatttaggcgcattcaggacctgtcccttcttttcaagggccttgccagtgcctacttgttgtcattgtctttgcagtactacggataaccttcctagataacccccctccaggaaactgtccccataaaccgggtgccctccgccatgattagtttgtatttgcgagtgtgttacttggttgtgttccctgaatatttatttggttttcccagctaagttgtaacttatttgaaggcacaaaccaaatctcataattctattaagtacctaaaaggagtaaattattgttaatgctccaattggctaatgtctatttcatattttacttaccagatttacaaatgcttaatattctgaaatatttcactctcatttacaaaaacatcagattctactaagcagaaaataaagtttaatgcccccagcacatagcagttttgagttgcacttttaaactcacttcttaatccatttcagggttttcaattgttcacagttaattcttcttaccaagggtgtattacacttgctcagcattgaatgatatggaaagaatggcctttctttcctgcataactgactttacttttgttcataggttgaaatcagcccttccatttcactgcagtattatattagtggcatttttatttagggaaaaaaaaaagctttcttccacttgaacttttgttacaaatcagtttattgggtccaatcaatgggcaagacctatgaaagggtgtggattatctggttggtcctttgtgtggcaaaaggcttagatgctgcttagtactcgctcattcttcatcatgtaaagaagtgttttttttgaaggatcaacacctgactgagccctgcctttttcatggaaatgttttcacctgagttgctgcttatggtactaagaattagttaactaatacttatttaaccttggaacaatgtttatcataatccgattggcagatagtcattttacttaggctttttctttatagcatcaggactagcaaatctcagtaaagagtatgctgggagcaatttcttttttcccaaataggttatcactctgtgctttttttttgctttccgtcaaggggcatgtttgggcactgtggacattaagactggtggccacacattaggaaggtggaggtcccctcttgggttgagcaccacttttgtttttaaagctgcatccccatttcatgctgctggcagtgtttcccttcagacgaatcccatgcaatgtatcactttaatatattcggagctgtttttcatgataaagcttccttatgagcactaccactaattaatacacaaaatggcccagcacaatttaataatttggtaatgtttttcaatgttttcttaaagatgacgctttacaagtcaagacccaaacttgcctgggtcatgacctctttgcagtttttggagtcttgttaaacaagaaggaaagcaaaacataaattagcgtctccagtatggttgctctacatttcccaatctttcaacactttgaagagcatagtcactgttaatgtaagagaacatctcatgaggaaactggcagcgattttaaaagtccggctttctggaatgagtaagaagcttcttcctcagtgccactgttctagggccaacattgtcctttgtgagagaggagcaagatgaggaagtttgcattatggactatggaacattaaaaagctaaaaaagagaagtaacagttacctttaatcatactgaggatgtatcagcatgtgtggcctttggcatctgttagcctttagggctatgttcccaagtttgccattagaatttagtgttaaaaaatactttaaatataacagcaccactttttgttatagtaaaaatgtatgtctttactcgattgtaattacctcaacacccagcttttgttgttattttgcccttggacttaggtatttctgttcctctggcttagaatgtccttccccttcatcttcctaatcaacctactcattccttacgactcaactcatgtatcatctcctccagaaaaagctttctctgccacgtgtttcttccctctacctgacatccttgtgcgtaatacctccacctttccatattgtactataattatctattttgcatctgtctttctgtggaaggtctgttgcatattcatctaggaacttggtaaatgtctgatgataagcatttgattttttcctagttgattcctcaaataataataatgattaccctttaatctgaatgctcacaggtgtacttctatctcatattctatgcgcagtcatctgttaagctaatggctaattgtaccagagggtctcaactttgtttctttgatctgcattggtttatggtggtaccttgcccattcttggcacagcaggtggataaaaacaatgagtaacattgagaaaggctaatgtgtcttattgacagtagtggtataatgtttaccaaacccaaattgaaattattttggtttcttaaaatcttttcccgatagcccatttattttaatgttctgaatttccaagatctgtgtataggttcaatgattagtctttactgaagacttatctatggactgagtgtgtattataaatctagtgacataagtttaaaacttattcctttttcattttccaagtaaacttttttagtaatgtgtttttctttgtaaagacaggcagtatatgatttaggtctggatctggtttccagtcttggctccatcatgtattggttatttggccttgaacacaaatgacttgccttgaacacaaatgacttatatctgtgagattcaatagcttcatcagtaaaatggggatagtagtagtactgaattttcatgattataatgaaaattaattgagagactgatctggagaggtgccatactacaaagaggattaagtggaggtgtccctattaaatggcgagatacccagaaacattaccctgttgactccagtatgctggcaacgaggctttatagtctttgggaaggagactggaagattcttctctgggaaaaatgtacacatactgacctttgaaggacccccagtaatcagccaggtcttacctgatcatcctatagtgaagccccccgacacagtatttccattcatagtttagctcttaaatgtgaattagctatccagcaatcaccagacacttgaggaaagcctccagaaaacaaattggaaaaaggggcaagtcataggaaacagacaaaacaaggaacagaagaaaacatcatttttgcaatctataatattcacaagtttgttttttgagacagagtctcactttgtcacccaggcaggagtgcagtggtgccatctcggctcactccagcctcaaactccttggctcaagcgatctgctcacctcaggctcccaggtacctgggacgacaggcatttgccaccacacccggctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaagtattagaaagagaaagaaataaaaactaagagtaaataagaaaattagaagattagtcctagagaatcagtatccaactaagaggttcccagtgggtgatacagagaaaatgaatgggaggaaatctcaaggaaatgtatttcctagaactgaatgattggaatttccagtttagaaagaaggaatctagtgccagcaaaatgagtatagaaagaaccatcttaggatatgtagttttcaaattgcagaacataggaatgaagaaaagattctgaaagttttgtattaaaaaggttagaaacaaaagatcaaagatcagatagcatttgtcttttagccttcagtgccttcaaaattgtgagaaaaaaattatttctaacctttttatttatttatttatttttttgagatggagtttcgctcttgttgcccaggctggagtgcaatggcgtgatcttggctcggctcactgcaacttctgactcttgggttcaagcattctcctacctcaacctcccaagtagctgggattacaggcacgtgtcaccatgcccagctaattttgtatttttagtagagatggggtttcgccatgttggtcaggctggtctcaaactcctgaacctcaggtgatccacctgcctcggcctcccacagcactggaattataggcatgagccaccacacctggcctctaaccttattttttacaactagccaaactattaagacaaaggatacaatagtaaggctagaataaaggtatttccagacatgcaaggtctttaaaattttacctccctcactctttctgaggaagcttttgggtacatgcagcatagacaggggaatagatgaggaaaaggaaggctgggatacagggaatctaacagaagagagaggaaagctccagaactacagctgtgccccaggcctagagagtcaccgcttcagattgaactgtgaacacacaggactcctggaggggaatttcttcaagaacacaactttaaactatgtaatgtgtttgaacatactgaaaggagacttgtgattgttttagagacaaacttgtgataagtacctggtaaactaagcaaaggggaaaaaggcaattaactccagtaaaacaaaatgttgtccaagaaaggaaattgaatagtactctgcatggcctagctgtaaaccacatttgtataaacataataaatactgaatatagatttaactaaagactgtgaaataactgtatcggaaggatgtaaaaaggggcatgtggtgggggaaggggggtagtgcaaaattaataataaatccccatcttccatggtaggaagttagtaaatcatatttaaagctgaaaacaaaaatctaaaaccagtaatgtaacattattatttgaagataaggaagtaaatataagaagaaaagccaagagaattgaaaatggttgcctttgaagaaagggaactgagaatggtagcataagcctggcatagtttttaaactttttttaaaaaaatattttggggttaaaagtaaaaatgaaaaatattaaatgtgacaattatggaaagcactttagcccatgccttttacagttcagtgttgcataaatataaactcttattaccctgctccttctaaaaagtgtactaaagccttgtaaagccagcgccacatactttctattcatttcatcttttttccccaattcccaccatacatgtgccatgttggctctgaggaaggaattacatacatacacgtcagtatctttccatttgtttgtgtatcttcttgatttactaatccattgttttattgatgtgaatgagaaggagctgttcacatgttgccactttctgaatcatgtggttggtaccttttttcaggattttcaggaaaatcctgaattgttttcttctgttttgcctaatcatttgcatcggcaagattaaataaaagtcttttgcaaattgtgttcaagcttactgtagtttcctaattagtcttattatgtacattttaacacattttctccctatgatcagggccgcaagcttcttatcattgggaccactagccgcaaagatgtccttcaggagatggaaatgcttaacgctttcagcaccaccatccacgtgcccaacattgccacaggagagcagctgttggaagctttggaggtaaaaatgagtcaatggattgcacactgtttataagaaaggaattgaggctgaaataagtagtaccacattatacctggtgtttggtttttatgctaatctggaacatgggacccggggatattacaggttgtatataccttatccaaaatgcctgggactaggccaggcacggtggcttatgcctgtaatcccagcactttgggaggacggggcaggtggatcacttgaggtcaggagttcgagaccagcctggccaacatggtgaaaccctgtctctactaaaaatacaaaaattagctgggcatggtggtgggcacctgtagttccagctactcaggaggctgaagcaggagaatctcttgaacccaggaggcggaggttgcagtgagccaagattgtgccactgcactccagtctgggtgagggagcaaaactctaacaacaacaaaaaatgcctaggaccagaagtgtttcagatttcagattttttcagattttggaatattgcattatatttaggttgagcatctctaatctggaaatctgaaatgcttcagtgagcatttcctttgaatgtcatgttggcactcagaaagtttccaattttggagcattttagatttcagacttttggattagggatactcaacctgtacctccagttgttttcaggaattagagaagaaagatgaatatacatgacagtgagttaatttcccattcctcaatgtaggcagctacaaactgccaggaattaattgctctgtatccagcatgagtgatgtatatagattacttggaccagaaacttgaatgggtggtggtgtgggggtaaggtaatcactgtatagaaaaattaaccattcatagtggcttttagcacatttccttgcatttaataagttggaacaatgattaaagccttagaaatgtcaaaaaaaaaaaagctacagaagtaaaaggaactttattaacaagtttagaaatagaaatgttttcttaattttttgaaaatgacagtcatttttaaaaaagaacgttcttcatttaacttttaatatcaatattcacaagtaacttggtgagctctattggaaaatattatctactgagttgttcagcagtggtggagtcagtaaagcttcttaaagtcctcaaggcccccaacaaaattgaaatttatctatatgataaatgttttcaggttacccatgtagacagcttttgtgcagaagctgggtaagagaattaaaggagtttgctttgacacatacagattgttcctagaaaagaatgttaaaaattttaacttatatttattatggattggagctatttttttccccagaaaatataagttacatagcggtccataagaaaacagggtttaagataccagttttcactttcatgattgcacctaatgggtttaggatggtgaaggtcagactggattttaaagtaggagagaattctatcaacttgaacagttaggtagttcttatcactcttcttttaaaggtaaatagaattaaccaatgttgatgtgttcactgtaaaagtgctttgattattgtttattgtttttgtagcttttgggcaacttcaaggataaggaacgcaccacaattgcacagcaagtcaaagggaagaaggtctggataggaatcaagaagttactaatgctgatcgagatgtccctacaggtaaggtacttcgttctccgtatgactcagacagaacaaagcttcaggacacaccaagagggttcagtatttcctttgccaaggttttaattaatttaagttttgattttcttatattatttccaaacttaatttggtattagtagcctgcttctgagattgatcacttaacaatactttttaacttcttaaaattcaaaaatggaaggaaagattataaagttagttttcatttagggagccactaggtcttagaactagaaaagacttcaaagagcagtcgttcttctgccccctcattttggagatgaggatactatgtgagccacaggctgtcagtgaattatccaagatcacatcaccaggttattgatggagaagggatggtgttgcacctcaagtcagtaagcgactgcacatataccaaacggtgtctgggagactgctttaagggacaagttaattaagttgtgcagtctagacttgggatctgtatatttgtccctggctgggctcctagaaatttcatgcaaactactgtagggttgaagcatccagaatcacatagaaaactgagccccagggtgctgcctgggcaaagacagatgaaacttctttgggactttctcatatctcctggcaacttacctttcttcattttagaactccacccttccatgtgcccatgctgtgtcttcttgtccttatctgacatactaggtagctgataaatacctccctatcaagccctatgagttcagagaccttggctcttactattgagtccacagcccctggaacagagccaacacatatgaaggtgctcagtaaacttttattattattattattattttgagacagggtctcgctctgtctcccaggccggaatgcagtgccatgatcatggcttactgcagttttgacctcgcaggctcaggcgttcctcccgtctcagcctcccaagtagctgggactaccagcgtgtgctaccacactcaactaatttttgtattttttgtagaaacatggtttcactatgttgcccaggctggtcttgaactcccgagctcaagtaatccgtctgcctcagcctcccagagtgctgggattacaggcatgcaccactatgcctggccctcggtaactttttttctttttttttcttttgagacggagtctcgctctgttgcccaggcttgagtagtggcatgatctcggctcactgcagcttccacctcccgggttcaagggattctcctgcctcggcctcctgagtagctgggattacaggcgcccacccaccatgcctggctaattttttgtatttttagtagagatggggtttcaccatgttggccaagctggtctcgatctactgacctcaggtgatctgcccgcctcggcctcccaaaatgttgggattacaggtgtgagccactgcgcccggccagtaaacttctgttggatgaataactgtaaattcattttacagttaggtaaatggacagagtggctgtattctaggcatcatgtgttactaggtgttactaggtccatctaggtggacagagtggctgtattctaggcatcatgtgttacttactgatggtcctgcattctgctagtgtgggcagtgagcggcagaggtgaagtttctgtttcacagttacatctgaaataggctcttggaccaataacaaattggaaacgtgaagtgaatgctttttaatcttttctggtaaatttatctgaaaataaaatttttttgactttcagaaatctaatttaatctactgagctttcagatggactatttttaagtcaattaatttattttccattatgagccataaattaaagtcacagactaaccactttgtttagacttattcttggtaaaagtgcaaatacaggtgtattggctctttccttgaaaaaaagataaatctgtcagattgtcagcttctttttttttaagtttcagtataattttttttcaataattgcatagaagaaactatgtggattttttccccaaccctcatccctttcccttcctttgatgcctgcaggtcagtgatcaagttaatgcttcttatgcatgtgggatagagagtgagagtggggcactcaggcctgatcttcagcgactgacatttcataggcctctgagtttgaaccccttcatgtcaaatggatttcgtgcagctgagtgaattctctttagatctgccttagagaggctgaacctaagtgaagaggcatgtagttttgcagaatataagtcgtggtacctctctgttcactacatgctattctgttaaaacttgcacagagctgaggatctgctctgactggatgtcacctgagggaataaagtcatttatctagattacttttttcctccctttctcctgacttttaattccatagctacaggcaagtcagtaagttgttgctcacacatattaaatatatttaatgggcaaagaactgcaagtaccaactacaactgcgctccagccagttcttttttttttttttttttttaagaacttgacaattgattcatatgtaattctattcccaaaaaggaaaaatgtttcttttgttagctattcacactttttcttagtcctttgtagtctgacctcttacctttgatacatttgaaacttctgttcagtgtttttctgggatagaagaaatcttaaaaaaaaaagaaagaaaagaaaaaaaaatccgtggttggagtgggagtccaattgcacatctccccacagctgcactgagcatttgaaagttattcctggagggcagggagttccctcttgggaaacagactcctgctctgaaacatattttaaaagttaggtgtgtttcttacaataaaaattcatcttcaggaactaaagatgtttttaacgattgttttctagataacttcatatctcctgtgggcctacgagaataaagtacatttaacgagttagtataaatatgaatagaaaatgaaaaccagtcgagatagctaataataacgacctgaacgaagcacctgaaacaaagttgcgccatcttttcttagactcatgacacattcgcagtcacaggagacccagattcatctggagatgatttcaggaatcagcagtactcttcatttttttagttttagcacaactttgttactacaaagaagaaactatatgacggatactgaggctaagaaaagctacatggttggttatgtagagttaataagctattttttagttgttgaattaacctcaacttggtatcttctactttgctgtgactttagtagccttttacaccttcaacaggtgaattggttgtcatttgaactctgatgaatggccctgtccagtctcacagcgatgcctcacaggcatcagcacagggcacgcctggcccaagtgcctatgatggccagcgggcttgggtcttttggaacccagtgtacatagttctggaaaaccccattcacttcctccaaatgatgtgatctgctttgttttgtgtgagaatgctggtcaaggagcaggtaacacattcagtgacctagcagagcattgatgaagtgtgaaaccgaacactgccttctcatgaagcaagtgcagagttgttagaaggtaccattaacccatcttcatttcttctgatgtatttagatggatcctgaataccgtgtgagaaaattcttggccctcttaagagaagaaggagcgtaagtacatacaacatttaatgaccatcaaccaaacttaccaccctgttaaatccctgtgcctattctaagagttgctttcctagataagtttgtttccatttatttgaattcttcgctgtgttgtaggtccgagagaccaagcaaggaagttggttgtactgttggtttgctctccctgtcctgcttcgcaaaacttccttgtcacaatgcaggaaaaacttaatggtacatatttattggaacctgcttttacatgcatggagctgtgaccattttcttttgtgaagtgctcatctaatagcaaatgcatagtgggaaatgtaggataaccattaagaagcttttagtgattttttttttttttttttgatgaatagttttttacggaccctcatctgtttttttgtgttttggtatttcttttgcagtagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaatgt

SEQ ID NO: 991 - DNA, 166646 bp, Homo sapiens
cggcggttgcacgcctgcgcgagggcgggcggcgggggcgcgcgcgcggcgggggcgggctttgccgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacactcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggtgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatgtctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtaactgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggcctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccagtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactcttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagcacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcatggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctcctttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccatataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatatgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacctgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctgactatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctctgtcacacaggccggagtgcagtagtgtgaacatggctgactgcagcctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaatacaaaaaaaaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaataaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagtgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagctgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttttttttttttgagatagggtatcactttgtcacccagtctggaatgcagtggcgtgatcagggctccctgtagccttgacctcctgggctcaaacctctcacctcagccccctgaataacggggattactgatttgtgccaccaagccaggctaatttattttctttctttctctctttctttctttctttctttctctctctctctctctttctttctttctttctttctttcctttctttccttctttctttcttttctctctttctctctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacatcctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaagacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatactttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattacttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccaagtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgcctgtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaagtgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacattcatgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagccttttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatataagtttaacttatttctaccccatcacttctagtcacatgtgacttcagaattttaacagaaattattattataggaatatgtagcacagagggattccataggcctgaagattagtactgatggcctttcttgcattattctaggctagtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatgggggctggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcctggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtccttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctctttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagccgttaaaggcttttgtatcagatgctatcactgtaactttgttctggaatttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagccagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccatttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccagcctggctaacacggtgaaaccctgtctctgatgaaaatacaaaaaaattagccaggcgtggtggtgggtacctgtagtcccagctacttgggaggctgaggcaggagaatggcgtgaacccgggaggcggagcttgcagtaagccgatatcgcaccagggcagtccagcctgggtgacagagtgagactctgtctcaaacaaattaaaataaataaataaatagataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtaaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgttttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgattcatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaagatactgctgctgcataacaggatttgaagcttctatcttacacatagtactttttagttacctggtataggagattatcatgagaggactgtttttttttttatttacaggtaatttctgaacagggaattagcacaaaattttttaaaacagtaaatattgatatctacatgaaagctgatgtattttaggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttcttttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagggatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagatcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttatcagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttatgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactacctttacccagctttaccaattgtcatattttctttatcattctggctccctgtcttcctctctgggtctctgtctctctctgtacacacacacacacacacacacacacacacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagaagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctgatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactacagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacacctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccatctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccactgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggattttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcgcccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggctgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttacgagagctgctactgtatccttaaggggccattggtaaattttaggacaagtatcttcagggaacctaaagggaaaataaatgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttatgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacgtatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtcaagttgcatttgaaaaagcagaaaattcgtcacttaatcttattggtaagatttacagtttttagaagatttgaaatgaagtgggcctatttctatatgtaactcaactacagtgatttccaaatggggaaaggaaagaggggcatctctcttgagagagtttatcacagaagcatggggtatttcctgttggtcagtttgctgatgaaaacgtttaaaaccttcatctggatcaactttgtccaatagaaatagagtgtgagccacatgtgtaatttttaatttcctagaaattgcactaaaataagaaacaaattaattttttaacttttaattttgagataattttaggttcacagatttgcagaaatagctcagagaatttctgtatgccctttaccagcttaccctgatgttaatgtcttatttgacattttcaaaagtacaatgataagaaatgaacatggtttcatttctgctaactaaactacagattttattgagatttcaccagtttttccattgtgtccttttctgttccaagatctaatttaggatcccatattgcatttagttgttctgtcttttgagttttcttcagtcactgacagttcctcagactttgtcttttatgactttgagaactggtcagttattttgtagaatgcccctcacttggttttgtgttaaatgagatagcatcatcatttcttttagtgattaagtgatgaatgtgcaggtcaagtcttcccagcagattcatggttcagtcctactcttgtactctagcacaatttttgtcatattaaaacaattgcagcttattctctgagaatagtaactcaccagaataatgtgacattaactgggcattaattcttatttttggttgatttaactatgttgatgtctaccctactagagagtagagggttttcattggttgcacatcatcatgtccagggtcacttaacagtctttgagtgcgtggcctttatttcctggtccacaaattaccattcccccttattgttttttgttaattataaaatattttatttataaaatatggataggcattcgaaaacaattcacacactgtaaaatttggttctgttttcatagttttgtaatttgctttttttgcttagcatgtttcaaacatcttaaatatacacctataacatgatttttaatgcctgtatgtcattttatgaaggtaggatgtattttcctgttattgatctagtacatttatgaagtgacttctttgtattttatttttgtgtaccttttgttaagatatcccaagggagttgcataactttcataggtatttctaagtaatccatgggaaaaaaattgtgtagttaattggcattcagtaaattttgcccacaagagggcagtagagtgtaagaaaaaaatatttttcatcgctttccaaaggaaatcttaaggcctcaaaactctaaccataaaattatcatctagtataaacttttaaaaagcgttactttatttttaattgacagataataattgtatatatttatagggtacaatttgatattttaatacatgtatacattgtagaatgatcaaatcagcctaattaacatatcacctcaaatatttagcatttcttaggataaactttttttaatgtgacattttcttccctggttttataaaaaccatattattactttattttttgtttataatagagcatactaaggtacttaatttattctttgtttgaaatagtaaatgtggttctcttgagttactttaggtggcactctgacatttaagttagataatttttgtcctcttgagaatttttaaacatgagttttgtaatcattgaagtctttaggatgatttcagacttttgtgtccaagtgaagagaaagcaaagaagacatcaaacttgttcagtatatttccttaggctgaggggttatatgcccaattacctgtataagcttaatctggataaatatatgtattttaaaataaacttgcgttaggagacttcagtgactgcgagatttcagttgcatttctgccagctagtgttgtcttcatcagatatggcatttcttctgatcaaccgagttagttaatttagttagattgaaggttaataaaactaagttttatggactgatacaaatagactacagcataagtttagctagtcattttgacagtgtgttaccatatatggagatcagacaaagtagatagcatagcaaaacttacccttctgactgtaaaatcagctaagattatattgttcgttttgtatatgtaagggtagcttttctttattcatttaggatgctcagggagttctgtctgtctttttagacttagtgataaagtccttgtttcacatttgataatattcgtttgacataggcaaagctaaaaccaaggaaaatcgccaatcaattatcaatcctgactggaactttgaaaaaatgggaataggaggtctagacaaggaattttcagatattttccgacgagcatttgcttcccgagtatttcctccagagattgtggagcagatgggtaagtttaaaaaggaaaatgttataaaatcttgtgttgttaaaaaaattaatgcaatgaagaatctcttttcaatagttttgaaattatttttcagacccattatttttgtctttttctttaaaaatgaacagataaattttctgaaaaactttataataccagaacttttaaaattacattttaattttatggggaaatcatagaaataagacttgtggtggctccattttgtttatttatttattgaagaatgcttttctatggggcatatttagaaacttcccctgacagtaataatactagtagtgactccattttatttatttatttgcgtaagaatgtttttctatagggcatatttagaaagttcacctgactctaaagatcactatgggtcagatgtaccctgctgaataataactatctattaggctgtgtgcattgttctgacattagctgccgttcctttttattgtactgttgcattacccagttagtacatcttcatacctaataaatgggtacttgcatatttttaaattaaataagtttgatccaaaaagacaaatgcaggatatacattggagtttctatattgcatacaaagaagtgcactattcgtttaccactttcttcttgaaggtttatttaatttatctgtgtgaagtgactttatttgcccagtggaaatgctgtcatgactgttttcatgtccatatcattcgttggattggaatgtgagcaacagaatatctgagaaaggaatgtataacataacagcttctggcagactattagtgtaaaaacagcatccaaaaaaaaatggaaggaatatgaatatattactccgctcatccccatcattctttatctttaaattgctactggaagataaaagtatatttattatagtggggataagaactgctttctaggcactaagtgcttggattgtattagccttctattgttggtagcctttctgcctggtcgctcactctgataaattacaggcacggcacacacctgttcactgagtaaaggtcgagtttggaattggattaagagaaaatgacagagaccctcatcacctgagttttatacaccttgaaatggcaatagcatactttttatctcaaagatacaaaggccacgtccattaaaagcagaattttaattgggaaaatattttaaaatgtggtagttcactatcttggtaatgtgtattttcgatcaagacatgaaaatattgtttaagtgtattttgggtaaaagcagggataaaaagatgattccaaatgttgtaagttattcttgtggaatgtttttactggttttcagaactgagatctagtgcaggaagagtctaatgattctgtttcttagaacatttatactgtttagccaaaaagtagaaaaataactgcattggtagtaagccgtctcttttaattataaatgttttctcactgtttggaagctattgaagataacagttattcagatactagtttgctatttgtgcattatctagatcctgcacttgaagctacgcgcaacgtcagtatgcgttgggtagataatgcgtaaaggagttggtctcacattggtcagtttgtgaccttgccagctgttggagagttttaaattaaatcagaacagatttggaatttgttagtgaatttcatctgtttctgatatccgtattgaaatgagctgaattacagtagtgtgctttttgttgtttttgatgtgttttttgactaagcactatggatttgaattttgtgagtgccactgtccagaaccttttttatggatttatttttctaatatttttacactaatttaattagacaaaaaatgaattctatccttttggaaaagttttttttttttttctctttatggctttttgccatcaggaagcatttgttaccaatttcattgaaaagacaaactagtataaagctgtcctggcttttgagctgaattgaaaaacttattttctttattctggatgaagtttctgggtatctaaaaaaaagtaaagcttcttcttttttttttttttaatggttaaatggctgagaaataattcttttgtaatgcatgtataattccctgtcttccaatagaggcttcttttttcctttgaattttgggggaattatatagtaaaatcctttcttgcactccaattacagtgtggttataaagttctccttaggctttggtaaaggtatataaataaaaatggttatattttgacagaatataaataaaattatacaaattatttttatgcatattctgtgttgtttttttttttgacatgtcaggtgggaacaacatggatttttttcccccactctttgttaactaaatagacagatctatatggtttggggattcagctggacactgagtatgactggttaaatcagttctaatttttaaaaaagattagaaaagaataatttatgtaggttatggggcttttttgttttaagcagaaaactttacttttggcttgagaccaaattactgtctttaccatggagtctaaagtgatgtctacttcgtaaacaggaatcttaactaagtggattttttgcctatatatcaattttcaaatttacaaagtgataaatttagaatattcttctcttctgtcattatgttcatcagactgataattatgcttctaggtaacagagttctttctttttgtctataaaacttcatgttgccttttcaaaattgaaaaatatagtttagctacgaacagaatgttgctgatgagatataggaggactaaaggacttaacgagaggcacacaattaagcagtaaaattagggaaccaatgaggtaatatacttgaaaataactgtcatggagtttccaatctgttagtttctctcttgaaggtctttcaaataggtagtgtataccttaggccgggtgcggtggctcactcctgtaatcccagcacttagggaagccgaggtgggcggatcatgaggtcaggagatcgagaccatcctggctaacacggtgaaaccctgtctctactaaaaacagaaaaaattagccgggcgtggtcgcgggcgcttgtagtcccggctcctcgggaggctgaggcaggaggatgtgtgaacccgggaggcggagcttgcagtgagccgagatcgcaccactgcactccagcctgggcgacagagcgagactccatctcaaaaaaaaaaaaaaaaaaaaaaaaaaaaaaaaagaagaagataatgtatgcctttctgcttttgtagttttgttatatttttgtagaattaaaatcaaggaaacccttaaaggagaaaggaagtcacataaagctctctagactgagggataaaggaaaagggattatttaggggaatatcaatttagacttttgtttttgttattgttttaatcagagcaactgttgagttttccccttgtctgaagcagttgagctcacccaaacccaagtggggcagcccttccttggaaggatatgagagcaacgagcgaagaaaactaaacctataccttgcacttagtaaataccaaatagatatttagttagaatgccttccaaccccccacaaaacagatttttaattaagaattaccttaaatccataattttatgggctaatagaagccacatttgagtcccagggtagaaatgtgaacatcaaagctggtatctggaagtatgggtgaataaattcaacagctgattgctgtctttcagcatattcaggtgttaactgaatagatactgaatacttgtgttcggacatttaccacacttattcccctgtatgcagttttgtggacagtgttcaggataaataaatgattgattacctcagttctcactgtagctattttgttagcaaagatagcgtttctgccaagaaacttcattttttcagcatccctggcaattctctctaaattataaatgtcaaagcaaaaaaacacatcgttttcaatgaacagtggaataattgttaaagaattagtcagcatctcttaatgtaatcctgggaataggttcacatctacccaaggaaagacctagaaggaaaaggatgtaaagagggaagacctcagcctcacactgtctttcagtggatctgtggggtgtagatgttcaggccacctagtggggaggaaagccacttgttatggtcttgtgcccccattctttgaaactgacactgtgttctttttggtctcctttccccagtgtctccctctgtaagcccattttcaatcgtatttttaaggtttcttttgaaattcaagaggaaagcaactcttttctgatatcataagtgaaattgtagttactctatgaaacagaactgctgagaagataaggaacctttcaatcacacagacatctttcacatactaaaaacagtgcaaataaaacatagtggaagaaagggcactaaggttttgtgcatgccatattttggagagagggagttcttgctaagattaacataaacactgacactcttaaaatgcattttcacacccccactcatgaggagagattgcattttaaatgggggttaagacatccaggcgaactccagggctctgtaaaaggaaccctaaggctaaagagcttatctgaaatttgaaaaaaagaaaaaaaaatgaagccttctgacattcatctttttttcttgtattagtcataacttgcttttcagctatattttaggttttgaatgccaacctgacatctgttcaagtctgcctgtaatttattagcagaggaaaagacagcagttgctcactagttagagatgcaaaatttctgccttcctgttctccactaagtacttatagatgatacctggatacgaagaatgtaataatttactgaaaacttcaggtcaggaaatttataaagatttttttttaattagaagaataaaatggcttaagaccatgtgatttcaaaaatctctagatcaggatttagagacaaaacatagaccctaaaaaatactttagataactttctataaattgtaatttttttaaccttgaattaatttttccattggttttaaatttttaagttaaatgtatatttgaacagtagttgtgcttatatctgaaagtcaaactgtatgtaaattcacctggcattttgcatttatagacagactttaagaaacaaatcttttggagaggtagtgctgtctacagagtcaccaaatggattagatttcctggcaactacagttgagttacttacagatcaacagttgggtcactacaaagttgagatctaagtgttaacctgagtgcccaccagtaagaaaccggttagaggcaatcttaaaatgatatagctccaaatgtagagacatgtttgtgttaataaaaaatatataaaagcaaatgcattctaaaaatctctaaggacatacattaaattgaaaaaaggtttatggctgaatgtggtggctcacacctgtaatcctagcactttgggaggctgagatgggaggatcacttgagctcaggagttcaagaccagtctgggcagcatagtgagaccttgtctcatttatttatttttttaatttaaaaatttaatttaaaaattaaaaaaagtgtttacttccatggaagggaagctaagatggggaataaagggaaagttttgttcttttactcaattttacctttatgtctgaatgttttattgtatttctaatgtgtgattttaaaagccaacagacaaaagataatatcacagtatgtttcttggggtgactctaccatcagcatggaaagtcagcaggaaacaggtacatccttccgccttcatgaagttttctgtggaggaggagagtgcagggtaaaaggcctggattccaagggctttgctggcagccccttagagggtagacagaacacctatcctatttggtcaagaagagaaaaagtttctccatatataacaaactgctttcccccagaatgttctgcattatagtaatggtgtaagtagtctgcccttcaaacatgagaacatttgcatccaggcctttaggcagccaaggcagcattaaagaagaaagagtgggagcagagcgagctgagggagagcagagcttctgacatttgaggaactgggcgtgaatttgtttttagtcttcaaaaaccattctcttgaggaatcgaattcccatgactcctgaagtgaagcggttggtgttttctcctgcgttactcccatacgtaagttggtgattataatgagggtggtggctaatacttatataatgccagacgctgttctgtgtgctttattattgtgtttattaatcctcacaacaaccttcagaagtagacactgtattgtctccatattatggagcaggaatctctgtctcaaaaaggtgaagtaatgggtccaagacacacagctagtaagtagtagagtcagatttgaacccaggcagtcgagccccagatttcatttccttaaccattacatgttattctcccatgaaagcccatcgtgtaaaaccattttaatgggctttctagcttcacttttttggggacctttgaagcaatcattgaggcagcctttgttctagccaagggccaaccatggcaccattgagattttgagctgtataattatttggtctggggactgggtgtcctttgcattgtaaataactaacttttctagtaatctgatgtgttcaaattgtcatgagctcaagagacatgaagatttggtggtaggctgtaatacctaatgccacttttttcatgtgttttttgtcacgtgttgtagcagaatacaggaaggaaggaactggaatgggtgtgtcagagaagctgtcttaaactgtcaacctggagagggaacataaatgttaaaattaaataatcattaaaaaattaagcaacgtaacaagtgatatcaaaggccagtatttgattaagtgccagatgagcagtacaattgataagccctacaggaactgaaagggaatcacatcgagaagacttcatagaagaggcagagcttgagtaaggccttaaatgctgagcggttttggataggaggagggaaggggatagttgtccatatcctgggaagagtgacagactaaacacggtatagacttcatgacttagaccagtctaacagagctgttgtttggaagaaacaggaaataggattaaaaagttagttttgggttgggttgtggaaatctgtgaggagatgtggactctttttaaagtactgtccctgtttaagcttccagacagactcagaaccttccagacagactcaggtgcttctcctgtgtttccctgcaccttgtatatacttagaatccagctgtgttcttaatgtaattattcatttgcattacactcctaaggcagaatttcttaaccttggcactattgacattttaggctggataattcttagttgtagggcgcctgacctgtgcatcataggatgttaagcgccatccctggcctctacttgatgtcagtacttcccttcctcaccactccgagccccagtgacgattaaaagaaatgtgatgaaactgtcctgtgttgagaaccattgctcaaaggcctttgaaggcacaactgtaatgtcttcttatccatgtattatcaacatcaggggtgttgggatgtaggttgcaggtcattgttggaccatgaaccactgttaccagtccacaataagacaaatattggaaattaagaataagtaattacaaatgtttatagcaatttgacattatcacaatttttttaaaattatattttacaaaaatgttggtctgcaatggattggaaatttaaaaggaaaaaaaatacagctggaccttagcatacatagtttgagaagcactggcctatgtaaatatttgcaaaatgaatgaaattttttgaacagatgccttagagaaaaggtgaggcgaatagtcttagagaccagtagactattgctgtccagtgtgtggtacttagaatctggattggggtgaaggcaacaggaatggaatgggaagaaaatacatgaaaaaattgcagacatgaaactggcagaatttggcaatagttattgtgggtgacagaattggaggtgagactcaggtcttgtgagaaaatgttggaaatgagaaactcaggagaacatagttttggaaaagtagagaatatcattgcacatattttcaatatcgtgaaaggaaactggaagctgaactgaagagaggaagaattactggcatttcaatttattgaagcctagcttcaatcagtctgcacgtgtttaggaaacacactgttgactacttttgcttgaaataccctctttacttggcttttctcactccaagcatttctggttttccttttacctctctggctgtctcttttcaacctcttttgtgtcccttaaaatgttggggttcctcaggagtctgtctttgacctattatttttctctaattattctcctccaaattaatcacatctgtttcatagcttcaattagtatctttatgctgctaactctcaaatatgcatatgccacctcggtctcagtttagaactctggatttgtaccagcataatgtgttgggtatttcatgatcacatagtaagcttgaaattaaacacattcagttgccccctcagtcctctctaaacatgcatctatatctgtgttttctatctctggcaatactctagccaaaaatctggacacctttaactcctctctttccctcacctcccacttccagtaagtcgcagaatagaccgtcaattctgcaatctccgcaatctctctgaaatccctccagttctctctacctcgccctgccactcttccttcaggacaccattatctcttgcctgaattgctccataagccctcagccttgcccttctctaatccattctccacactgtaactggagtgatttttataaaaaggcaagtctgatcctgtcactgcactggttcaaactctttagcagcccgccttaactccttacatggtttacaagccctgtgtgatctggctcctgctaaactttcttgcttcgcctctcagcccgtgcccctcccccatactctgggttccagccagcctgtgctattttcagttcctctaatttgccatgctactttctcttacctctatatcctagggttatttttttttgctttttttttttcttaaccatcttttcatccaattcctgttcactcttcaggccaaagctttgaactcactgtttctagaatgagtaggctttaatgttcctcatgtgtgttctaatagctccatgttattttatgcattattacattgtattataattgcttattacatgtctgtattccaagtcctctctccatgtccctgccctcacaaacatagtataccttcagtaaggaataggccttgtttattttggtcactgtcgtattctctcctcccggcatggtgtctggcttataagttttcaggaaataaataaatgccaggaacttgattaatcttgattaattaaatagaacacttagacagtttgatccaagccctgccctcatgatacttacagtctgtgtgggagtaacactgtatttgcacatcccaaagcagtactgtgtaaaacataaggtgcattgtgaaccagattagcaaagtaggccacatggagaagcagcagatgcatttaaagagcaagactgagccatatctttaaaagtcaaagcagatatgatgtttataattcattactaaatccatgtagatcctcttagattctgaatttaggaaagacctcttggattggtcctgaatggcactaggctccagaaataagaaaaggaagagtattttcttgggtacttgtgagctaccatttgcttcattgggaactgccattcttatgtaagggcactataacaagagtgttcacatttaagggcatcaggtcaatattgcgtctgtgtgagtttgtgtgcatgtgaatgcacacatgtattttctatttttaaatagaaacacattataaaaataatgcatcctcataaaacagcacagatagagtaaaaagtgaaatctcccttcattctacccactccagttttactccctctcttagaggtagacactgtaaagagattggtatgaatttttcaaaccctttcctaagtatttatacaataatatataatcaatccattcattcatttattgagacagggtcttgctctgttgcccaggctggagtgcagtggtgcaatcatactccgttgcagcctcgcactcctgggctcaagtagtcctcccacctccacctgccaagtagctgggactacacccagctaatttgtgtgtgtgtgtgtgtgtgtgtgtgtgtgtgtgtgtgtgtgtttgtgtagaattggagtctcactatgttgctcaggctggtctcagactcctggcctcaagcagtcctcccgcctcagcctcccaaaatgctgggataacaggcatcagccactgtgcctgacttttttttttttttcaacctagtagtgtatcttgggtttttttctgtgataaagcacacagataacattttattttttaaaaagttaaatagtattagcagatctgcatccacacaagtcccgtcatggtaagttagcgtctcttcctcagcagtaagaaggctcctaggcacacaccagaacaaggttggcattgcgtctcctttctactcacttgtatggccctaggcttctcaatgcggcagggccctgggcgctcagctacttgagccttggtacccttgcctgaaaaattgtttattggtaggtaacattaatgtgtgtaagttttctaacacagtacctggctgactgtcaaacactccatggatgatagttacttggtatgattatattgccaagaggcacttttggagctctgtaaaaggcaaaaatttataacccaatccctttaatctaatgttaagatgtgttttcttcttatcttaaattttgttgctgttgaaaatagttaacacctgagattttcctcctatgctgttttataattacccattttgaacagtgtttgttgataaggtagtcaaggggacacttcgaaatattttttctttatttgtgaagtcatactttggctgatttatatttaatttttatcacattacatcggagaggagcagataaattttctatcacctctataaattttctatcacatataagaaagtgtatcttatatgtgatacactaacttggaaaaacaacagctatcttgatagacacaatagagaataggatgtcagaggaagagaagaattagaatgttaacaataatgctagtaaaaagctacccaggacttaaatggtattatttgagagtacttctaccatgattcaaataagacttgccttggaattccatatgatttgttacttagagcagtctacctttaatatgtttaatatggtcatactttaaaaaaaaaaacctgcaagaaacttgggtttcacgtttttgctttttaaagaattaacataatgttatttcaggtttgtaaaggaagttacagaagatagcaataaatcccttccatataccattttagtcatagtgcaaaattaggcattgaaaattattatgggtactgtattagatattcaaagatttatttgtggctttgacttctttaccaacacctctggctttaatacagtatcttttatcagagcaagtaatagtttgaatccttttcttacaaatcctctttttactcaagtgactgcaaacttataaagatgcacacatctgtagcttgaacgtctatgctatttgctcaagtatttacttgaatttatcctcgatgatatgattttttgaagtgctttgattttaaattctatctagaatcccatcatgagggagaaatcttagcaagacttaagcaccttttcataatgactggttactgtaggataaacctataattagtatgttgctaatccacacgttagatatatcccatcaaatttcaaatatacacaggagaattatccacattgaaggttattagtgcattccagggacatttccatgttgattcacaactacccctttaccttacactttcctgtgttactagacgtctctttctgtaaaacttctctttgttgttactttttacttttgtatgtgttacctgattactttggcttcctctgtgactactgagggagccaattgtggctgtgatgagcttagagaaagggagatggggaagactcgcttaaatgagttacaaattctctgtagtctgatctttatctggctattgcagtatgaccatgggtgatactaaatgaaatagaactcaactccccaaaatttggatttgtcttataagtcgtaatggctccaggtgggatactgtgtcagaccaaggataggcagatgatagtttattgccacagtcaaaagatcgaacccttttttttcatgttatctagaaatgaatctttaaaaaaaaaaaaaaaggaatgggttgaacttataatattttagcaactcataaaataacttgaagaaaaagatcatttggaaggagagacaaaacagactgaaagacattgtttaaatttatgacttttattatcttacttgaatgctatttttgcccctctcgctattattaaaccctttgcttcctgttttcagttgctcctgtcaaggtatgaatttttctttggatgattgtcatctatttcatattatctagtattcctctctattatgagaaaatcaaaagtagacagtgtatctatagctatagatttaaatgcactaaggtaattatatatttgaatcagagacctaaggaataatctagtgtagcatttaccaaatttatttaaacttaacatgcttacatgaagacagacctatttatgtttccaaggaacaccagtttgagaaatgctgatcttacctgtgtcattcttattttgtagatgaggacattgggacctcagaagaataaggcaacttatttaggctaaagtcactgcttgtctactggggctggaatccaggttgcttagtctggtgccctttaggcttcatgattcagccacttaagacaatttgatttattgttgggctttttaattctagatttcataacttggatatgaaactgtacttcccagtctccaaaataagcttcactgttttctggaacgtgaattagattcagaaagccccttactgcctttagattattgcagcctccccagtgggccccagggatccaggaaaaatatctttgtttttcacctagtcctctcctcagcttttagagggactcttagatctatgtttatgaaaagacttttattagttcttatagttgtagtaatgcatgtttattgtagaaaatttcaaaaatgtagatgaataagaagaataaaacaatcactcagtgtaaaaaacaaaaaaccctgaaaaagtaccattaatattctggagtatatcatccagctagttttagctgtatatacatagaaccaaaaaaaaaaaaaaaagcattttgctgttttataactggttttctccccactcagtaagttaacagtttttcttaaatattctctacaacattctttattttgtagaatgataatgctgtggtttgtttaatcaatcccctctagttagaaattgtattcagttttttactattatacactatgtttaacaagcaccttagaaactaaatatttctacacattcatatttctttaagataaattcctggaagtagaattgctgaatcaaaaaggattcacaagtgtaaatgtttttgacatgcactgccaaatttagacttcctttttgaaaagtcaaatgttaaggagatcaaagcaatcactaagcaggtactctggaagagaaatagaaatataaaaaatataatggtttcatgagaaactaatagacaaggtttcaagagacttggagtctagttttggatttgtcattgaatggctgtgacttttgggtcttagtttcctcattataaaaatgggaagatagactagaaatagaaactttttcagaatagtcaccttatgaatgttgtttcagtgaaatataaaggtctgtacataagttctgcagggaagatgccatgtatttgctcattcttcaagtttcagcttgattgcctttggaaggtctgtcacacttaacgtcctcctaatagaagtaattgttttactttttggctcctcatagccctttttaaatgttggttctgtatagttgtatctttgatttttaatattgaggtatttgtaacagaggttatcttactcatctcctgaaagcacttggcttagcatagttcttgggtatataatagagactcagtaagtatctgtggaagttgagagtgataccttgttccccagtgtataacagcaaagcctagcctcctcctgttgagcattgtctgttctcgctttgaagagctcaccacatttcttcagtttgtttttgtttttattttattttatttattttttttttttttggcggggtggggtctttcctattcagtaacacagtggttctcagtctttggtgtgtatcagaatttttttttttttttagagttttgctctgttacccaggctggagtgcagtcgtgtgatctcagctcactgcaacctctgcctcccaggttcaagcgattcttgtgcctcagcctcccgagtagttgggattacaggcacatgccaccatgcctggctaatttttgtatttttagtagagacagggtttcatcatgttagccaggctgcccttgaactcctgaccttaagcgatccacccaccttttctggtattacaggtgtgagccaccctgcctggcccagaatttttaatgttaaaaaaaatacagatttccaggctctcaagtacactgaatgtgagtgtcaggcacaaagccgagacacagcgctgtcaatagctgagctctccttggggttttagctttgtcaggcaaattgatattcaagttccaggtctgccacttaccagatgtgtcttccccttaccaggggaaggtcactttaccactgtaagcctcagtacctcttccttaaaaagagggtaaaaataataccttagctcatagttttaaaaatgattacgtaagagaacatattaaaacacgtagtatagcccttcccatatctgcagttctggccttgatctgtaacttcttggatcttatatgcatttattatttatttgtttctttttaaaataacatttatattttttcaacttttagaggttaatatgttcattatagaaaactgaaaaacacaagaggcatataactaaaaaatcatccataacagaatcagtttacattctgatgtatctttccagtccttgtatgtgtatacatatatacataactgagtatacctttttacatggttacacttatatagtatgtgccatgctttcttgcatatcatgagtacttgagtatcaaaatactcagggctttaggattcagacattggtaaatattcacgatacattttcttatcttttgtggggacaaaaatatcttaaaaaacaaaatggcaacaggtctctggaaatgcatattggcaggtttatagttaaatactgtgttcacttaatacccaatataaaatgagatacaaagcagtcaagtaagtataatgcttcttagatagttcagtatgagatctgcactattaaaatattaccagaaatgatgtttctacttaattatttaacaattcatatagtattcacaaagtataccaagaaaaaagcacacatatgtcagtggttataatcagattgtaaatatggacatatctatatatatctcttcccttacctttctttctgccccttccttagcaatccagtacgtactgatgtatactgctcataggtggtttaacattgccatttccaagatgcttcttttctaatgaaattaatttactatctagttaattcactagctctattttatacattgtcacctcataacatctagaaagcttagtgttgtgaagtaaggactgataaacagaggcactttactaaaaaatcacttcctagaactgtggctacaatatgaaactatcttctagatatgaacatacttgcaaagaaccttccttttgcctttcttcttccttcttcagctcaatgaataagtacagaaatgcatatagctctacgagatgggttaacaacagtcactcccagacaacaagccttgctaaaaactctaacaagaggacatttatcaaagaatcattttacttcttaaactttcagcatactttgggcacttctcagcattggggccttgtttgtcctttgcatactcaacaatgctaagtaaatgcacttgcagaacgacgagtagataatctgcatttatctcaaaacacactggcacagaactcttccaccgtcacttcctgtctctcccacctcctttactacccaatgagcaaagaatatgtagctcaaagagataaaagtttaacagttccattctaaagacagtcattcctgttaattgacataaacttacttaaagtgtgttattttgtgaagactacatgtttcaaacgtctactgtataatgatagcattgattaaattgtgtgcatataacaaaggctataatctgaaagtatcttcgaaatatgaatattatagccaagtacacttcaccttctcacttccttcttatcattatcagcccaaaggacaatatcagcgttccaaaagttgttttcagaagatagtcttacctatgaagttttcgggcatacaagaaaagtatataatatgttttagttcatcatctcttcttttgtcaaacattagcaacctctttatcatctagacaacaagatgtaaaattaggacttgcttgttcattgtacagataaccctcaatgggttatgtctcagcaaacccatcgtaagttgaaaatatcctaagttgagagtgcatttttgacttacagtattttcagttgactatgggtttatcttgtcgtaactgattgtaaatcgaagagcattaccaaatgcatattgcttttataccatcataaagtaaaaaaaattgttaaaagtcaaaccagtttaagtcggggaccatgtgtatacactatgtgcacagcaaagtaaaataaaatgcacagaacatgcaggtaatcttgcctaactacaaacacatggtatagaaccctttattccttcctacacttcctttgccttcctcctccctcagtccacaagcacagatctgtaccactcaaagaggaggtctaataatcccatttccgaaagacagtatttcattaaatttattaattccttttatccaggcatttagtggtcatttttagatgacctttaccacatatcttcagatgctttcaccgtccgccataagaatttttactgaaatgaattcttgaaatgtttaaaactttgttacattctttctcgttccacaagtagttatcccttcccagttacctttcttttttaggtctgtggagtcatgatacatctatccccttttcctttgtttttcatgcatttgtcaaatttattattgaatactcctaaattttttctgcctttatcatttgttttttctttttcattgctttagtcagttacccttgcactacagcagtagcctctttattatcttccttgcctttagtcttcttcctttccatcctggaatatttatttcagagcttactgtacaaaaataccagattctatcagagaacatcaaaggaatcacagaatctcagtattgcaaaggatcttagccatctagtgcacacacctgttttttatttgaatctcttctacatttctttttattattattattattattattattattatttttgagatggagtctcactctaatgcccaggctggagtgcagtggtatgatcttggctcaccgcaacctctgcccccctggttcaagagattctcctgcctcagcctcccaagtagctaggattacaggcgtgcaccaccatgcctagctaattttttgtttgtttgattgtttgtttgtttgttttgagatggagtctggctctgtcgcccaggctggagtgcagtggcatgatctcggctcactgcaagctccgcctcccgggttcacgccattctcctgcttcagcctccctagtagctgggactacaggcgcccgccactatgcctggctaattttttgtatttttagtagagacggggtttcactgtattagccaggatggttttgatctcctgaccttgtgatccgcccgccttggcctcccaaagtgttgggattacaggtgtgagccaccgtgcctggccttttgtatttttagtagagacgaggtttcaccatgttgcccaggctggtctcgaactcctgaggtcaggtgatccacccgcctcagcctcccaaagtgttgggattacaggcatgagccaccgtgcctggccttttgtatttttagtagagatgaggtttcaccacgttgcccaggctggtctcgaactcctgaggtcaggtgatccacccgcctcggcctcccaaagtgttgggattacaggcgtgagccaccgtgcctagccttttgtatttttagtagagacgaggtttcaccacgttgcccaggctggtctcgaactcctgacgtcaggcgatgcacccgcttcggcctcccaaagtgctgggattactcatgcctggccctcttctgcatttctgctgagtaacttctgccaggttccttaggctaagcttaagttcctccagtgacaggaatctcactccctcctaaggctacattcctcttttggacaactataggtttaagtttagtcttccttatgttaaggtaagatgtatttgcttgtatcttctcctacaagctctggttcttcccctgaaactacacagaacaagcatgatactacttctttatgaacactctttaggtatgaagaaagctattgtccagacttccctacagattcctcttttctctaagctaattctcctaagcttggttggttttttctagccagtctttttagccctttaccatcctattcacgtttctgtgaactttaacatttatgtatattaatgttaagctgtgaaacctagaatttagtggagtaatgcaaatgtggtctctgttgtaaaatagatcagaactatttattctttatttaaaacactagtcctttaatgtaggccgaaattgtgctaacatttttgacatcgacattctatcttaatgcttatctagtttactaatgaatgaaattcccagtcatctctcacaaaactgtatctcccccagctgtactcaagtacagaaaacatctattcttgataacttttatcttgttagaatagctcttttctcttctatagctacaacttgtcagtgtgtccttatcagcttatgatttaattgaggctatagaacatatacacttaaaaaaaataagctaagaactcttagaataaaacaacataatgtattgtcagttgtaaccatgaatgatgtttttcaaagtgtgtcctctggcctacattagagttacttagggcgcttgttaaatattcagtttcactccagacttaatgaattcagatttctaggagtgatgtctggaaatctgcattttaacaagctccattggacattggtgcatattaaaggttgacagctgctactctaagtactgaaggattgagcccaaagatatgatcagaattaggtggcattaataaaggaggtgatttctggggacagaagaacatgaactgttagagtaggtagaaattccaggtgtagtaaagaagaaataaattgtctgctagggaagatatttgctaggctgaattaggggcccaatagaacagcacataaaaggagttaaaagctaagggacggaaggaaaaaaaacaaagaaagaaaaaactataaaattctgaaaccagtaaagatacatgctgccatttggcagcaaggcagacctgctatagaagaagcatgatctttgtcatcaagaattcatgaaataccaggcaacaccctatgagggaatgtaaaagggtgggggtgtcagcaaagattagtttggagcattgctacacacatctcatctttagttctaggctatctaatgagaaaatctatattaaatctaagttgactgatttggatatagaccagtcggatggtagacagcttgcacagctgcttggtgctcaggaaataggctgttttcactagcatagcaaaactcagagtgctcttggcattttgaagttggtgggacaacagcaagtctctaccagacagaatagtgccacgaaaatggatggtcaaagtcctgactgcccagatggtatcaggagtagtggtcttggtcttaagtatttccatttcttaaagatttcataagtgcacagataaacaagtgtagatgacaacctattttagatgttgattgagagtcttaaggccaggcgtggtggctcacacctgtaatcccagcactttggaggtcgaggaggctgatcacttgagcccaggagtttgagaccagcctgggcaacatggtgaaaccccatctctacaaaagaatacaaaatcagccaggcatggtggcatgcacctgtgatcccagctactcgggaggctgaggcggcaggatggcttgagcctgggaaatggagattgcagtgagctgagatagtgccactgccctccaaagcctgggcaacagagtgagaccctgtctcaaaaaaaaaaaaggtttttgaaacaaaaggccctcctatataatgagtcaatgaaagttatgctcttagagtaaataattatattgtactactgaaatggtaagtcaagtagaactaagaaaatactcatgactctagttccaatttacaattttcaacagaaccataagagaagttgtaattatggaaacttaaatgatcaaatattaatttgtgtccaggcgcagtggttcacacctgtaatcccagcactttgggaggctgaaatgggtggatcacctaaggtcaggagttcaagactagcctggccaacatggtgaaactccatctctactaaaaatacaaaaattagctgggcatggtggcacctgtaatcccagctactcaggaggctgaggcaggagaattgctagaacctgggagacggaggttgcagtgagccgagattgtgccactgcactccagcctgagcaagactctgtctgaaaaaaatataataataataattatgattatatttaaaagatcaaatattaatttgtgattatattttctacaagggcatgcactatttaaaattgagcactcaaatctggtttgcacaactgcacagagaagcttgcaagactgccgaatatgtcctgacttgctactagtcttttgatagcctccttctttggcaaacatggctagtctgcatttgtactggaagccacttgggattcctctttaaacatcagtcattgttcaaaacccacttcgcacttctttctctctttatagatcatgttgcccccaaaatgaactgaacactcttatcttaatgctaatttgacagagaccacttctaatttattatcatcctgcttactcttatataaaattagtgtttgctatagttttttctccctttgaatacctcaaagttgactgacagtttttcctcaacgcagcttgcctctgataacatccagaaaaaatgaagaaaatatactgctttgtaaaatagaagagcttaacaagtacaaatttgtcacttttttcgggtgtttcgaaagagtgtaaacagtaaacattgctgtttatttcttgtgtttcagaagtaaggctatgtatttttatcgagctatttacaatttacatataagatgtaagtattttcatgaatcattttcatcagtggggtggatatacctatcatagcggatacggtcctattctgacttttagatcagaaatcactttcagttatttgtagcacacaccttaaagcctattaaagttctccccaccaaaatttgtattattataatcactggatgtcaacacctgtggctcaaacagtatccaaattttgtatattgttggaggattgctgatttaactgagagttgtagctagaaataaggtgagaaagaatatacaggtaatactaatccacctcaaactaagaagcaaaggatggtggatgggctatgttgatctagcgttgcaaaaacacttttggatgaagtgcccagaaatagccccagttcctttcactagaatcagctcgtcccaggtgaatgccggcagagcagggtgtgtgctccccaagaaagggcagtgaccgctttccaatgtctggcagttaggggcgatgagagtagttgcaattggcaagataaaggggaactttggaaaataaatatacttatgatagaggaggcaggagaaaaggtcaagggctgtacacatgtggaactgataatcatggtagcttggcttctatgaatgggtacatgttgacccttaagtgagcttagaaagcttgagaaatcagtatgcgtgaactgtttgaggcataagaaaggcaggattttaaaactttttttttaatttgtgcaaatttatgggatacatgagaaattttttacatgtatgtaatatgtagtgatcaagtcatggtattcaagggatctgtcaccccagtacaatatattcttattaagtatagtcatcctaccctgctatcaaacattgaatttattcctcctatcttactgtacgtttgtacctttagcctacttctccttagcctcccttcatccccagtcaccctccccagtctctgttgtctacttttccactctctacctccatgtgttcaaattttttacctcctacatatacgtgagaacatctgatttttgtatttttgtgtttggcttatttcatgtaagataatgatctccacttccatccatgtagctgcaaatgacataatttcattgtttttatggatgaattgtattccattgtgtagaagcaggcagaattgactctgatagtagtctagctggaagagaggctatagctacaaagaatcttgacttaccaaaacactagtaacatgtctgtgaaactgctgtagtctaactcatttactactatgttaatttggagcgtgaagttcatcagtggaatgggtactataatttgcaaagttcaagtgacaattctggtagataaagttttaaggagcagatggtcacaactgtcagtctcagaagtaatttggtaagtaaaatagtcatttatttggaagttttttggtaacctaattgtgatctaattgtcaccagttgggagtctaattccattttcatcactcatctgcagaaaggtgagagaaataagctattaattaatagccaatatttacgagctcttactatccaccataaagtatgctaagtgctttatgtgcattatacttaattatagtaactttctgaggtagttactattattatttccagctagttagtggaagaaccaggatttgaatccaggcaaactgactgcagagccctcacttttaacactacacataaaactgagtttatttaacagaaaacactgtcctttaacctgagattgtgtctacctttcaatactaaaatgtactttttatatgaaatggtggtgatagacgatgtcaggtttgattttcttttttttttttttttaagaaatctttaccttgcaaaactaaaactaaaacaacccaatgacagcactgctctccagtttaaagaaaacaaatgttcttttgctagttgtgaaatctaaatttgagaaccactgactagaaaagtgggactcttagtaatttttaaagttctttagagatttttcacctgatttattttctgatttcaacctccttgttttcattaaccttttccttaagtccacctcagccactcattcttcgattatacacaagactttgtttgccattaccagcaaccacaccactttggggatctcagatgtaagcatcttgctctcgcgctgcctcccatttttccttgcttactcctagcatttctcctgttaccaactccagcaacttggaccccactggaacctccagtataatttattctatcagttcccaatctttttgttctctctctcctctttccccagcttaacctccatggtctatcacatatatcctctttgtatacacctttagcagccttgctcctcatcttctgttgtcaaatccacaagtgtttctcagctacctgcctactctgtgccagtattctcgctgttaagcatggcttaagaaaaacacaaaaccacagtgtctgatctcactttaaatttatgaaccaaatctcaagtgagccctcagtatttcttggaacagatattcctagtattccttctgtatttccctagtccaatccatttattctcctattctctgagatgactagttcttcttctctatttggctcaacccccaagcaccacctcttccatctttaccagcagctgatgacctggaatctttacttcacggaggaaatagaggcaaacagaagagaacttcttcatcttcttcatcttcccaccacaagatgtatgattggttgaatgagagaaagactgtgatgtcctagaacttcagttgctcctatatccaatgtaattagcaacttaaattccaaaaccatatataaaaatcgatttttggccatttgagattatactctttactaccactttcctttctcttattataaccaagagttgttactatgtttgtgcctcatccaaataaaaagtaggtattttttagaaaatgattaacgggagcaattagtaaaacaagcagtaaaatacccggatacaggaaattgagccaggcttgctggtatgtgcttgtcccagctactcgggaggctgagttggaaggatcgcttgagcccaggagttccaggttatagtgagctgtgtcacaccactgaactctggcctgagtgacagagtgaaaccctgtctctaaaaaagtacttgacataggatattgagagaagaaatgctttggaactatgtttgattatacccttagcccaccttagttcttacttaagtaagttatagatgaaggagaaaagatgggaatcactttgaagattaaggcctcaaactttgtggaaaatggaggaaaaaatgttgaaaacagtcatgtgatagtttttaccttacacttttgatgggaaaattagataatagaattgagctatacgtatgttgactgcacattacattaatttaatcctgttatttacctcatattgctaacctttaaaattaagatttgaaaaaaaagagatgggtaaaaccaaaaaggtcaaaatttgtatgccagcttagatgaaatttgtatttatagaactgaataagaatctacaccttacctaatactgtgaattgcttatgtaaatacaacaaaggatggtccctcgatgacctgaatctcatatgctgagttcacttagtaacagcgtccgtctgctcagacacattttcccaactccccatgtgctttccaaacctttaccatgtttcccagtatcctctcttcatccctcattttgttgatgacctagttcctgcttcacatagtcaacagaacccaacaggaataacctcagctttcttcctccttgtccctttatttaactggtctcagaaggagaggtgtctttacaagctctccctctccattcctcctctgttgccaaagtttctgaaagtgtggtctccatatctgcttatgctacttagttttcttctaagtgaaaggtagggactcaaccccaaatgctctgaccctgttcgaagaccctgtggcctagagcggcatgtatttcctgatttctaaacctagtgccctttttccaggcctcatcctctatcactgcagcatttatctctgttgtcacattcttctgcttaaaacttttcacagcttttcacgtacccagggcaggcattcaaaaatattgaagcagtagttttgatgtcttttctgagctttcaccagtatttttaataggcactactgcctaaatgtcaaatgccttatagccaaaaacaagtaatgatttcctgtaatctccaaactgattcctcttcctcttgctatgtcttggtatccctgaggttaccatcattttatccatgtacccatgctagatgcctcaaggtcatccttgactcctcttccttctctggtttccatttggtttctaagctttgatgagtatctcccgcatcttcttttctttttctactatttcctatgactcttgcctctttctgtttattgtcttttgtctggattatttcagtaatatgttcaggagtttctaatttggattccatggatggacctcaaaggattaaagaactctctcaaatttgtatgcaaattttttgtgcatgtgcattttcctggggaggtccattagactgttctgtgggaaagagaggaatagaatgagagacaatgacaatttaaatcaggtccactgatttctcgttctatacctggcctttgttatttaggtcactaacctaaggcacttatctctgaggagtgaggtggcatgtaagatattaagaataaaacagcagcattagtcagtccagctgggcagtcagtccagcagccagagatcagaggctcctcaatatcagatccaggctttaatatcctagagaagctcaggagaaagctggggcatcagcaggagcagagggtgtcctcccgaggcccctggacccatttgttcctgtgcttccaaaggacttagagggatatgaaaacttaactggcaagaatccagagtgagttggtatccccagaaaaaggttcagaacattcccccagctagcctcccctcctttgcctgtttggtctctcgttctttctccactctgccaacacagttagcttttaaatacatatctcctggtgtgccttccgtgattgtcacttacacctaagggtgattagactaatcacccaaaaatgtggggttttaatcacctatgaaacaagttaaaaaatcatggtcatggtttcaaggcctgccagttaggagcctgccagcctcgtcgccaggcactgccctctcctcacttccagggctctggctacagcaggttactactggctgtttcgagagaacagtgtctgtgtccatatccctatgcctttgatcatgctagtctctctctttggggtggcatttcctctccattgcctgtgaacctcctactcattcttccaggcccacaatggatgttagctcttcacctgagtccattcttaattttctgccatcactctggcagaatcagtatctcttggctagagtccaaaaacatttcatacatatctctgataatgtcatattatattgtagatagcctatttttatttctgtctttcctactaagccagaaatgccctacagctagggactgtctttttcatgtttgtatccctaacagctacctttgcatctagtctaaacatgagcttagtacacttttgttgaatggaattagttataaagagtttttatgactcatttaaaattagagaccaatgcttacttaataagtcagaataggctgtaataataatagtaataataaagtcccatttccactgcttattcaagtaacagcttcctttgtggaagtacattttgaaagacttcacatgtcagtgtatatttttgatgtgctcatttgagatcctaaaagaattatagttctaaagcagactagagcttctattacattcctgttgaagttatattaaatatattctatcgtttcacatatctgtattatatataataagttgcatgggtaaacattttatctcttttaaacttcatggtaataatttgtgaattgtttattttataatatctgagtaaatttagttcaaaacacattaatttgagcattttctgtgtacagaagcatagttgcaaagttaagattcttgtgtttatgttgttttgttaaattcggaaagtctcagtcttgcaaatgtattttttttttaagtatttaaattagctcagctatgagaataagcacggtccataaattaagagcttcaaataattttttaaaatccttcatattctttgagttttgtaggaaaagaatcaacagtttacttattcagcctttcctgaagtccatagtaggtgctgggcatcatgctgggtgaatgagatagtacttgcatttgaatagtttacagtcttatagcgaagaagccatgtaaacagagaattgcaatataaaccttggaggagaggaaggaagactactttgagaaccgagattaggttgagaatggatgagtctgctgatcaatttatagataaagaagcagagaggtgaagtctttttttttttttttttttgatatgtgaaataggaacctaggttatctctaagaattcatagcagggggtagctcttgagaagaacagtgaagatctggataattaataaggagaattagagatgagctaacaaagacaagtaaagagtggcatgagaaagcagtgagcatagaactgaaactggatagcatgaaattctggaggtatcagtcagtagcacagtggtataattttctccagctgtgctatggagaaattatacacattgtggccaatgtgtagtgaataaagccatattgtattcagggactatggggtggttataacagaaatttacaaagaataaatagttaaaagtccttcaaagaaagcatggcttactagggaaggcagtatggttaagaggaagttgataaacttggagaaaatgtagaagtcaagaagttggagatcagaagggctggtgctttgtaggaactcagaaaatcttcattttcttctttctggatgtcctctccctatgaatgtttcaccaccacaacctgcctcagctacagtttatacatatgaatagtttcaaatcatgatggtaacagttggctcagagggcaagattaggagccagacttcaacgtgctgctaatccagcgtgtccctgtaacttagatgctggtagtgcttggtggtattggcctctaggagaagctcaaggcttctcctgttatctccctaccactcatacttggagggtgagtcaaaggccaaaaagcattttattgggcagtggttcttagggaagggatttactctgtgatgcagagggttaagactgtaagccatcaagtgtttcccctccctctccatgttcaaccaaaggcacagttcttattactttcaaggatttaaaaaggagtcttttctcagcataaaggaggaagtgaagaccaattttgacagcccaaagggtcttcctcctcagaatctaaaatttctaatagagttgtttgcatcttgtgattttacttgagtcatcaaatgtattgtactttttttcttaaagatatacttcttaatgctttcatttcagataaggacaaaccattttccatggcgacacactatttatattgcattttcagaaatttccctttttacccatacttaggagtgtgacactgaaacctgataatctattatttcacagagtgcttttttgggtgtaatataaagatattatataattttaataacctttgaggtacaagtggtttttggttacatggatgaattatatagtagtgaagtctgagattttagtgcaggacccattgtccaagtagtgtaaactgtacccaatattagttttttattcctcactcccctctcactttccccacttcttaattttctgccatcacaatgtgttgcccaggctggtttcatgccctcactttccccacttctgagtttccaaagtctattactctgtacacctttgtgtacccataacttacctccctcttgtaagtgaaaacatatggtatttgattttccattcttgagttacttcacttagaaaaatggcctccagctccatccatgttgtagcaaaagatgtgacttcgttctttgttatggctgaatagtattccatggggtgtgtgtgtgtgtgtgtgtgtgtgtgtgtgtgtgtgtgtatacacatatatgatatataataattatatataatttatcgttatatgtaaaacaaagcaaattttttatttttatagagacagggtcacaaagtattgcccaggctggtttcatgctcctgggctcaagtgagccaccacacccagccaaaaataagtaatatttcccagttagacattttcagagtaaaaagtatttgttcaaaatcatagcatgaatggactcttccagagacctttaactggcagcatttccccctcaaactttagtacagttataggaattgtttctggatttttggctgtatattcttgttcatggctcatggacattaacatatgtgaatggcatcactgtgtttttcctaaagtgcatacgaagaagaaagaacactttcctttagagtcttacttagattctagttagctgatataagactgttttcttttccttttcaggttgtaaacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggagggtaatgtgaacataagtgtgatttagtaaaagtttatcactcgctatacgatgaatgagacccagagttatggagacaaacttgttgctttgatttatattttgaagcaacttacaggtaaatttacctagtacctaggttatatatggcactgcaccagggactgtggaagatttacgtgatgagcagatgttgttgcccacatattcctataaacaaaggtaggtgattgtgtaagccagaggttttgcaaaaataggtcatgaatatattttcaggtgacacttttattccatattgcttccagagacttgtgctcatttatcctttggaagaaaaggggaaattaaatccataaatagacttatgaaatcgtattatgtaaggttcatatgcaaaaagctatcttacttaacactgagtcttgctcagttatagagtgacaggattgagttgtcagagctcaaaggaaagcttgatttgcgtctcagaaatgaaattatttaaaaatcaagctagaatttactaattctgatagttttacatgtcaacttgactaggacataaagtgcctaaatatttggtaaaacatttcggttgtgtctgtgaggatgtttctggatgaaattagcgtttgagttgatagactgaataaagcagattgccctccctaatgtgggcaggccccattcaatcagtttaaggcctgaacagaacaaaaaggcttactttcctgcaagtaagagggaatttcgacttgcctggttaccctgagttgggacattggtttggatgcacaccgaaacatcagctcttcctggcttggaggcctttgggctggaactaaataatgcgtattagctctcctgggtcaccaggttgctgacagcagatcttgggacttgtcagcctctgaaattgtagatttatcccaaggaattggctaaaacgattatggaggctgacatatatatgtgggtgtatatgcatacatacatattcatagagatttatcataaggaaaacacacacacacacacacacatacacgaacattctattggttctgtttgtctgttctgattaattatcctaatactaacatatttttttcattgacagtttaagaacaatgccatgagatttctggttctagcaatgcagtagactaggtaaccagaaaaccttccttctataaacaccttcaaatgctaggtatacactgtaccccttaaatatgcacagttatgtgccaattaaacacaaaataaaacttttaaaagttctgggtaaaacataactgaaatcattttaaatgcataattgagctcttcagaaagaaaactggatctccaggaaattagagtcgtgagatacgggctgcagcttttggtttcataatgtatgggtttgggttttagtacccactagggaacagaacatgagtccttgaatccatttacagtgtggactaggaactggtaccttcaaaggggttgtgtctatgaaaagagtggactagaaaatatctgctgccaccacagggaaattaacaaaaaatatttaactgcctgggttctggaatggaagctgggaaatctcctatgggaattcttcttcttttttttttttttttgagatggagttttgctcttgttgcccatggtggagtgcaatggcgtgatctcggctcaccacaacctccgcctcccaggttcaagcaattctcctgcctcagcctccccagtagctgggattacaggcatgcaccaccacgcccagctaattttgtatttttactagagatggagtttctccatgttggtcaggctggtctcgagctcccagcctcaggtgatctgcccgccttggcctcccaaagtgctgagattataggcgtgacccaccatgcccggcctcccatgggaattgtaaaccatggatccttgttcatgctggtttagaatttgaatgaatgtatgctacctatgtggcttgaaacccgaagctgagaaattagttaaaaaaattattcaggtgcagtggctcatgcctgtagtctcagctacttggaaggctgagatggaagggtcactagaacccaggagttctaggctgcagtgagctctcattgtgccattgcactccaacctgggtgacagtgcaagaccctatgttaaggaagaaaaaaattagtcctgggctagtgatagcataagttgtcagatataagcaaaccccagggggtgctccaacaacctaggctgaaaggaatagaaaaagtagtcatgaaaatttaaaactcagcaaccaagtttaagataagacaacaaatttcagctgaagagagaagtggtaaacagaagaataaacctaaagaaatcacccagaatgtagcacagagagataaagggatggagaagatgaaagttgagatgagagagttaaaacaagaagtccagatagaatagtgtagaggcattattcaaaaagagaatgactaagaatattctagaattaataaagacataagtactcagattcaggtagcaccatgagcctatatgggataaatgaaaattaacttatttctagacttgttataggagaatgccaaagaaaaaaaatcttagtaacaaaagaaagacatggagatgacttacaaaggggtatccattatgttgatagcaaacttttccatgacagaaagagagaacaaaaaacagtagaataatatcttcagagagctaagtgaaaataactgtcaacttaaaagttaatacccagcttaattctcattcaggaatgagggtgaaataaagactttttttcttcaggcaaaggataatagaattaactagttgcagaagcttgttggaagattatgaagcaagatgtactgagactgaaggaagttgaacccagaaggaaacagtagagccaagaaacaatgatgagcaatgaaattggtgaaaatatagataaagtctgggagttctacttctagtagtggcaaattaggtcatttgagtcatgtgttccactgaagactaccagaaaagctcaacacaatatttaaacatgttttgcttgaaggtatcaaagaagaaaaatggaggcctagaacaaaggtcctcctggtatactgggtcactgttcctctcgagatattagccagttctgcaggaagctgctaaaacctaagcagcccttttgacaggctagtgggagtaatgggggcagagattagtgcccatggcccctaaggaggggacacctgatgaacataactcattttgagtcaagaccctgaagggctacaccataggagcaagggttaaccaggagtagacatactctcactgaggctgcagatcagctttgaatcatgtcagtccctaaaattagattgagggttcctaaattgctagtgcccctaggcatctggcagaattgtaaatccttcctggaagaaagtggtatcatgtaaggtcacaaattgtttctagtttgcaaatgcaatgtctggcttataatcaaaagcaactggaaacagatacacaaacaacatcaagaagaagaaaagatggttcaaacagcctctagatattggaattctcagatacagacttttgaaataattatacttaccacattcaaggggataaaagacaagacagatttttggcagagaactggaaactaaaaataaacaaatataaattctagaactgagaaaatcagtaagtaaaattaactcaagtgaatgagtttaaatagcaggttagacacatctgaagagagaattagtgtactgaaagatataagatgaaaataaccagagacaaagaatgaaaggaattaagagagagtaagagagagagagagagagagagaataccgtttaaaggtctggtgcgtgtatttaaagttccagaaaggcaagagaaagaggatgaatcaaaatcaggatttgaagagaaaatggtttagaactttctaaaactgatggaaaacattagtccataaattgcagaaatgatatgaaccctgagcaggagaaataccaaagaactctacatatataggcattattgttaaattgctgaaaaccaaaaatgagaaaaatcttaaaaggagctagagagcaaaggaaaattaccttcaaataagcaacaactagctagtagctgtcttctcaatagaaatgatggaaacaaaaagtcaatcaaaggccatttttaaagagctgaaagaaaataactgtcaacttagaattttatatccagtaaatggatgaatgatcatagaaatatataatggaatacaaggcagtaatgaaaataaatagcctacagctatatacagttgtgaatctcacaaataaattattgagcaaaagaaaccagatttcaaaaaacacatactgtgtgattccatttatagagagcttacctaaagtatagtgtttaacaacacatgcttgggtggtaaaactataaaggaaaatgaattattaccataaaaatcagattgtggttacccatggggaaaggtcagggaggagtgcttgggaggggttgtgaggaggtgctcccaggatgctagcagtattctgtttcttatgattacgtaggcgttcattttgtgacagttcattgaggcatatattcacattttgtaacttttctctatgtgtgatgtattttgcaattaaaagttttaaaaataaattttaatagcattcactgagaaaaacaataatgatatgaatatttttaaaggatagaactaaaatatggaaaaaaacgtttgggaagtagattaaattcatgtaagctccttatattattggggaagatggtagggagtttgagaccagcctggtcaacatggtgtaaccccatctctactaaaaaaatacaaaaattagttgggcttggtggcgcacagctgtaatcccagctactcaggaggctgaggcaggagaattgcttgaacccgggaggcggagattgcagtgagccaagatcgtgccactggattccagcctgggtaacaaaagtgaaactccatgtcaaaaaaaaaaaaaagaagctaataatgttagttaacattaagtcaaatgtgcatgtgaaagttgtacattgtgcccaaacttttccaaagcatagggaggagctgggaaagaaacagtggaaattcaaatactttagaaggcaagaaagaaataacaagactcaaagacaatgtgatgataataaaaaggtaattttaaaaacaatttcatttatagcagaaatcagaatgtaaagtgcctaggattcgatctagcaggaaatgtgcaagacctttaaggagaaaattctaaacatttttgaaaatctttttttaagcagctaataaatggtaagatataacatgttcatgtatgggagaactgacaatgtcataaaaatgagttctgcccatcttggtctgtaagttgagtgtatttccagtgaagcctaataggaattttttaacatttgacaacttgattctaattttttttgaggcttgaagagttatgagaattttgaagaataatgaagatttacttttatcacatatcaagacttactagaaagcaatagtaattgaaacaatgttatatattcatgcaaaaacagaccaaggaaacaatagaacacaggaaggaagagcctgctctatgacaagtgatgatacagatcagaggggagtaataggctggctgtgccttaaacggagctgagataattgactacctatttggaaaaagataaaatgcaattcctacctcacagcatacaaaattgcaagtggatttacaaaaaaacaaaaacataaaagcctactaaaatttataggaggaaaacttatttagaagaaaaataggcaaaaatgttttaagatttgaggctagggaagaattgatacagaaagtaaatccattggaagtgttaatttggctacattaatataaagaaaattctgtatgacaaattacactgaatacaaatgtctcaaactgggagaagatatttgcagtgtatataatctacaaagaattggcatcctctataataaattctctataaaaagtcttgtataataagaaaaatataaataccacaatttaaaaaaactgtcgaaggatttaacacgtagttctcagagaaagaacacaattgaagaaaagcaaatgaaaagatattcaggaaaatgtataataaaagagggattatttcttaaacaacctggcaaaatttacaacagctggtaaaaccaagagtttgtggggttatggagaaacaaggtctcatatacattgctagttggagtataaactagaagaatataccaagtgggtagtatcttgcaaataaatttgacatcttacaaaaatgaaaatgcacaaaccccatgagttctacttcaagaccactacctatgataaacaacatgacatgtaccaggatgttgattgtcatgctatttgtaatagaggaaaaagaaacatcattactcttccttagtaggaaatggaatagcatacagatattaaaatgaatatgctgagcacagtggcccacgcctgtaatcccagcacttcaggatgccaaggcagaggatcatttgagcccaggagttgaagaccatcatgggcaacatagtgagaccccacctctacaaaaattaaaaattagccaggcatggtggcacattcctgtggtcccagccacttaggaggctgaggtgggatggtcacttgtgccggggaggtcaaggctgcagtgagctgtgatagtgccactgcactcccgcttgggcaacagaatgagaccctatctcaaaaaaataaaatgaataatagatttacatagatcgacatgaataacactcagaaatataacatctcgtcttcaaaaaaaaaaacctagtaagctgtactgaattaatctatcctaccatttaaaatttttgttgagggtaaaataatattaaatattccctttatagcaatcctcttagtgctttaagtctgcttgttgggtccttaattgtttcaattttatacaaggtcgtttcctttcctgctttccagcatttcattaagttcttgttcaggtctccagctagatcagtctcattggttctagcaggtgtgggtcttggtgggttggtgcaagtccattcactatttcaactcttcagaaagtcccggaaccagtcagttttgcagttcattcctaatactaagattgtttctgcttcacttatctttttaacttacctcagtgtaccaagaaaaacagtcatcaccatatactatctaggttgaataaactccgcttaaaaattattttagattattttccaaataatttacaaaatacaagaataaagagataaaaaactattaaaaattaaataagaacttaaatatataaataaaatttttatgccatgtttccctggtcttgaggtgttttggattttggtttttggaatatttgcatatacattaagatatcttggcgttgggactctggtctaaacatgaaatccatttatgttttgtatataccttgtacacacagcctgaaggtaattctgtacaatattttaaataattttgttactgaaacaaagtctgtgtacattgaaccatcagaaagctaaggcatcactatctcagccactagatgtggatggtctgtggttggttggcatcaccattgtttctgagtgtaaatttatatgcctgataaataatcgttttcatacatgtattgagacacaagtacttaacagtaaaaaatatgacacaccattaatacagtgaaaaaatagtgagtttagggtaactaagcagcacaatggcatcaccagaatacctggataagctgttaaacaacagcaacaccaaacagcaacagtttcagtcaccacctacgatgttgtggggggcttttgttttggtttggttttttgagatggggtctcactccatcgcctaggctggcatgcagtggcaccatcatggctcaccgcagcctcaaactcctgggctcaagccgtcctcctacctcagcctcccgagtagctgggactacaggtgtgcaccaccatacctggctaattttaaaaatctttttgtagagacaaggtctccctaggttgcccaggctggtctcaaactcctgggctcaagcgatcctcctgcctgagcctcccaaagtgctgaaatgacaggtgtgagctaccatgcccagctgatgttgtgttttgattaaaagattatcatacagtaaccccctgtgtgtggtgcacctttcagattttggaacattttggattttgaatttttggattagggatactcaacctgtataccccaaatgggcaggagcctctgaatgcagtaactgttcatcagctgtcctgcatgaacttacaaatactgattctaagtttcaaatacatctttgttggcttctaaattattattacttctggttcttcttgcacttacagcatcaaaacataatgctttaagaatttttttgagatctttggctcctaattttgttgaagagaggatgaccattatatgttccacagttgcaaaacatttttatttttagatttgtagatacctttcagaatgatcaattctgttttttatggtcaatccaattttttaatgtctacttcatctatttcttctggctatctctctgtaatacctgccttcagcatctgtctacttttaaactatatcaagaaaatttggtgcacaaatgaaataaaagatgaaagaatactgtcatgtgtccttttagcaaaatgggatggcctcatttcttgtcacaagatattccacaaagaagactttctattgaataagtaactgaatgaaaatgctttgtccttagattaaaagtatattattcactcattgattcttgagtttgagaaaatgtatgtagggcatcatcatctgaagacacatagactgagattttacttataatcatcaatttcagcatctttattagagtcctaagtgctcctatcttattctttgtgttcaacttctgactcatctaataattctaaaacagtttcctcagattttcttcgtcattctggctagagaacttacaaatgttaatgcttaatcgtattcaataaaatgtagaatgaggtcacaaaagatgttagctccagacttcttttatgccttcttgaaagataacacatatcttgcacaacacagtaagaaaactgaagagtgatgtcatagtgatacttgtttcactgtttctaagtaatttagtcattttttattatactttaagttctgggatacatgtgcagaacttgcaggtttgttacataggtatacacatgccatggtgactggctgcacccatcaacccgtcatctacattaggtatttctcctaatgctatccctcccctagcccccccacccactgacaggccccagtgtatgatgttcccctccctgtgaccatgtgttctcattgttcatttcccacttatgagtgagaacatgtggtgtttggttttctggtcctgtgttggtttgctgagaatgatggtttccagcttcatccatgtccctgccaaggacatgaactcatctgtttttatggctgcatggtattccatgtgccacgttttctttatctagtctatcgttgatgggcatttgggttggttccaagtctttgctattgtgaacagtgcctcaataaacatgtgtgcatgtgtctttatagtcgaatgattgtaatgggattgctgggtcaaatggtatttctggttctggatccttcaggaatcaccacactgttgaaacagcatggtactgttaccaaaacagatacatagaccaaaggaacagaacagaggcctcagaaataatgccacacatctacaaccatctgatctttgacaaacctgacaaaaacaagcaatggggaaaggattccctatttaataaatggtgttgggaaaactggctagccatatgcagaaaattatacaaaaattaactcaagatggtttaaagatttaaatgtaagacctaaaaccgtaaaaatcctaaaaaaaaccgtaggcaatacctttcaggacataggcatgggcaaagacttcattcttctattttcttattttaatcctttttaagcatagttgagaataattgatgagtaatgatgtaatttctagtgtgatgaaatagcataatgtgtcttagattcataaaaagatctagtagatccaaatggcaattgtaagatagaattttattctatttttttaaatattgggttttttgttttgtttgtttgctctttggaaaaaggaaaaaagtcatgagatatcaatttttataaatagtactacttaaaacagaaactcagaaactgagattgggtctaacggaccctaatgagatactgaggattaaacactaggcagaagtgagttaaaatgccatatggagaagcattttataacatctcagttgtgatagttaaccacatggctgcataggtaactttggtgctgtttttaaagttgcaagcaatttaaatattaaactactgatgataaaattgagttagcaaagaatttccagttcgatattaattatagccagccttttcagttatacctttctcacatccagaaatggcttgatgtactcagctaatgacctcatgcaggatatatatgtgtgttacataataaagaaaaacatcacttctgtaattttggacagtccacactgacggagatgaacacttgcatataggtcaaactagttaaatatagaacagccgcttttgaaagctgttgccagggctcaacagcgtcagctctgtttctatggagaaagactttgcagatgttaaaaacagagctagaagccaatgaatggaagaggattgtgctgtggaaatttaatttttttgataaagggtttattgatgaatcagctatattagtctgtgaacgttaatcttgacatcttctttacccaattcccaatttcttggaataagatcttgcttttatttaagtaacacacaatgtaaaatttgatgttattgtactgactaggtggggtaagggacctgatgacaggtaacaagattagtaaggttctgaaaaggtcagaattgtactgaattatgtttagaacagattgcctccgtgatcatttaatcaaacagtgttcgtattgtctttgtccttgtccacatacgtgatttttgaggttgggctgagaaggaaatcatgattccatcaacaacataaggcacattgacagtaaaactcatatattatagcagctttttgtttcatgctgtatagggcagacaaccttgaagaaaaaaaaaactttaaaaaataatgtaaaatttcacagtttttcagtcacaaacagaagtatccttgttgtcactgaagatgacaagaattaatatcctgctgtatagaagtactttggcaaagttaaggttgtagttccaattcctcatttccaattttttctccagatggaaagatgaacagtttttggtattgaatttttttttaggaagcaagttatttatcattagatatctattcagtaaatgcaatgatacagaaaaatgaagtttttttccctcagatttgaaattaggttttaaaatatggagggagaacaatttgtaagtaatgttcaggaacaaaaataaaacctaatgaaactttagaaactttgatggacatctgtcatcctacatacaattgcattaaagaatagaatttattattattttatctggtttattatgctgtaaaatgaatttttctctttttgtatgtagttttatgaaatttcatacatgtatagattcatggaaccactgtaaaaatcaggatgtagaacatttgcatcacccccaaaaactccttcatgcagtcccttactggtcaccctttctttttagtaaccctggtaactaccaatgtgttctccatccctgtagttttatcttttcaagaatgtcatataaatggcgtcatacactatgtaacctttggggactggctgtcttcagcataatgcctttgagattcatccaagttgttgcatgtgtcaaacatccctttttattgttgaatagtatttaattgtgtgggtgtactatcatttgtttatctcttgacccactgaaggccaattgggttgttttctagtttggggcaattatgagcagagctgctataaaccaagtagtggaatttttaggtcatatagcattttatctattttttatttaaaaatatatattcagggtttgtttttgacccagttgaatttccttcaggtcatttttggaactctttcttcctatgtctgatgtaacatttcatctttcatctttgtcatttttttattcccccttttcttcagattactataggtatattctggtattgtagcccagaatctgtcctgcttttatattcctccagcttaattatatgatccatcttcttacggtatctacggcttgctacaagactattctttactatttgcagaagacgttcagatgtatcttgctatccttttttattcagttgtgtatatcttgttctctatttggaggcctttccaaatagatgtcttgttaactctttaatcttatcatgctagaaacaaacaaacaaacaaaaaaaattcccttgtatcttttcccttctgcagcttccttatcatactacagggtaatttcttttcttcactgtcagtcttccaccctacatgcaagcaataatcaaatctagcatttgctgtttggtcatcaccactcctgtcaccaaaattctcattctgtttagattctgcttgcctcatttatgtaccattatttgtttctcactgaccttccaagtgcatactccttttcatcctaaagccaagaataaaatcattttatataaagagcattctactttgcagttcatttactgatgtcctctgtttcagtaggaaggcctaattctagatttcagtctgtcatgatagtactataacttctgcttctcacattaggtaaattttattatcccttttataggaccttgactgcctctgggccttctgttcagttgaacccacatgcttctaacttcttagctattagaccctctctttccccttttatatgtctttgttttggtacagcttctcatacccaaaagcaggtatacctgttagtaaggaggatacaagttgtatttgtaggtggtatgattgtctacctaggaaattcaaaagagtcagatttttttaaaaacttagatattataaataagagtaaagtagccatatataaaataaatacataaaaatatatttccttcatacttctatactgtttctgaaatataatagaaaaatcccatcacaattgccaccaaaaaacatagctaggaatctttatgaaggaatgaaggaatttaaacaacaaaaactataaaactttattgggaagctgggcccaatggctcacgcctgtaatcctagcactttgggaagccaaggtgggaggatcacttaagtctaggagttcaagaccagcctgggcaacatagtgagaccttatctctaaaaataaaaataaaaataaattttaaaactttactgagagacgtaaaagtgttgaataattggagaggcattattcttctaaaaaaccaaatatgctatacagattttagtatttcctaaacttagatatttaacctaatttcagtcagagcttgggtttttgtctgttctttatttttttatttttaattggtggaggttattccccctcataagaatgattctgatgttcatttggaaatacacatggttggaaatagccaagatagttatgaaaaagaagaatgtatagaggagaagagcttcttcaatgtactactgtaaagttatggagataaaaacatgaatgaatccattgagcagagtagacaggctggtaataacctagcatacatcaaagtccaaaccttggtatgatggcagctcagtcaacgaagaaaggagggataatttagggaacaatgctgggtcggttatttgaagaagaattagttggcttctcactttacttgtaccatacacaaaaataaaacaccagataaagaattatatgtaaagcaaaaatttaagaaaagaaaatatgtgaccatcagtgtctgtaatggggaacaattttaaggataaaactaatgaaaatatcataaaaataaaaattgtgctggctgtttagtagaaacagaaaacgccttccacttaccgaaaatataccataaataggctgggcacagtggctctcgcctgtaatctcagcactttgggaggccgaggtgggcaaatacctgaggtctggagtttgagaccagcctggccaacgtggtgaaaccctgtctctactaaaaatacaaaattagccagacttgatggtgcacgtctgtaatcccagatgtgagaggctgaggcacgagaatcgcttgaacctgggaggcggaggttgcatgagcagagatcataccactgcactccagcctgaacgacagagcgaaagtccatctcaaaaaaatatatatacttatatatatgcacacatgccataaagaaaagacaactggcaaactagaataaagtagttacaagtataataatggccctaatgtataaatcattttttaatcaataggaaaagctcttgaatttcaacagaaaagggtatagaagacatatcaaatactaataaaattaccaatggtaaaaacatgattttttaacagcaccagccccttcagtaattagataaatgtgatttaaaaacaacagaaagatactattgtccatctatcaaattgagaattacttttaaagtgtttctaatattcattacttgtgggaatataccaagataggcactatcaggtactgtgctgggattatagattgataaaacctttctggaaaagtgtttctactttttcaagtgttcctatttcaagggccttaaaatacttaacacaccttttaacctaacaatttgcctttagcaagtattcatctatattgtcaagcgtttaagtataaaagtgttcattgtaggctgggtacagtggctcacatttgtaatcgcagcactttgggaggttgaggcaggaggatcacttgagtcctggagttcaagaccagcctgagcaacatggcaaaaccccatctctacaaaaaaaaataaaatattttccaggcgtggtagcacgcatctgtagtcccagccactcgggaggctgaggtgggggattgcttgagcccaggagtttgaggctgcagtgagctttgatcgcaccactgcactccagcctgggcaacagagtgagatcctgtctctacaaagaatgaaaaaagaaaatgtttattgcagcaacatatataatactaaaaacttagaaataattaaatatctaacagtaaggaatgaatatggagtaggagagttaaactgtgaaaccattcatatgattaaatattatagagctattaaaaatcatatcatcggccaggcgcggtggctcactcctgtaatcccagcactttgggagggcaaggcaggcggatcacaaggtcaggagatcgagaccatcctggctaacacggtgaaacccatctctactaaaaaaaaaatacaaaaaaaaaattagccgggcatggtggtgggcgcctgtagtcccagctactcgggagtctgaggcaggagaatggcgtgaacccgggaggcggagcttgcagtgagccaagatcacgccactgcactccagcctgggcaacagagtgagactccgtctcaaaaaaaaaaaaaaaatatatatatatatatatattgtatagggatgggaaagggtttaaaataatacctgtactgaaaaacaggatgcaaggtattacatagctccattttggctgagtttgagatgattgtgatttctttattttttgctattttcccacattttttataattatatattttgcaattggaagcaaaaataaccattgaaaatcgttttcaaagaataatattcaagagaatacaaggtgcagtaagttcttaatatttagttaaaatatagaaatctgtggaccattaacagcacttatctttaggtaatgtaatgatgttttatagatgggtctttattgatgggatgtcactatgttgcccaggctggtcttgaactcctggcctgaagcagtcttcccacctctgctttccaagtagctgggattacaggcacaagccatggcaaatgtagtatattttaatttatgtttttagtgatggaatctcactgtgttgcccaggctggactccagctcctgggctcaaggattcctccagcctcagcctccagagtagctgggactataggcacgtaccactctgcccagctttatttttacactttatttgttttacaacttttgctctgttaacaaatctactactcctttaaaaagttaaaaaacattctcttattaaaacaaagattaggctgggcatggtggctcacgcctgtaatcccagcactttgggaggctgcgctgagtgaatcacctgaggtcaggagttcgagaccagcctggcaaacatggtgaaaccccgtctctactaaaaatacaaaaattagccaggagtggtagcacatgcctacaatcccagctactcaggaagctgagacaggagaatcacttgaacccgggaggcagaggttgcagtgagctaagattgcgtcattgcactccagcctgggcagcagagcaagacttcatctcaaacaaacaaacaaacaaaacaacgattatatccttatcagagatttaatggatactaaccatatttaatcctcagtctcattatgctcatttaatttttattatccgtatgttgtcatatttaggttatgttcattttttaccagttttgttaatccctagtattttttgtttttgagacggagtctcactctgtcgcccaggctggagtgcagtggtgcagtctcggctcactgcaacctctgcctcctgggttcaggtgattttcctgcctcagcctccagagtagctgggattacaggcacctgccaccacacccagctaatttttgtatttttagtagagatagggtttcaccatgttggccaggctggtctcgaactcctgacctaagttgatccatcctcctctgcctcccaaagtgctgggattacaggcaggagccaccgcacccggccgtgttttttgtttataaaagaaaaaatttccagagtgcactttactccctgataggagactaaattacttaaatataaattttagaaggtacgtgttaaattaacctaatgaattagtagcattcagaagtgtttgtatctgttaaagattcaaaatatacaaactaatttcttttaatggtgattctatttctagtaaactaaggcagaaatcattatgcagaagaaacagcaccctgttaaccatgttctttttataaaccgtctctgttctcactttattgttaggaaggcgtaatctgttttcatgtaatataagtacatgtgagtcatgttgagtttcttcactcatttgtccaattcccagtcaacctgtaggtggagttaacctttagttacataatataacgaaacaaacattaaacctactgcttctgggacagtcttctcaccaaaactcagggaaaatgggagggtgttgccactgactgacttaatgaaagtatctgacaaatgtaaggtctttcaaatagtgagataagaaatgtatataaattatttgatcgactacttactttctatctatacacacacactatcagtatataatgtgtattttcattttatagctattaaatatgaggttctagaatgagttttcagtttgcagaattctgagaatctagttccaacacctttgagaggacaacaaccacaattgcacttgccatatttattagtcaaaatgaagcgaagtcaatctgttgaaagctttgttttgtttttctgattagtttgtttaataagacattcaaattatgatctttaatataatttcttcccctaatagcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggtatgtttactttttaaaaaagtactattcattcaaaaacgttagccataagttctgaattaagatgtgtgtaggttgtgattaaactgttttgccagtgtttccaaattagaatccagtgatattgaagaatctattgtaatgcctaggcttaataggaaaaataaaagatggatttcagtcacttgtaggtttaagcttatagctcacccacaggtgaaaaagatgtaggttgaagcttatagctcacccaaaaatgaaaaatacacatgaaacaatggaatgcagtggttttcaaactgggtcttgcaggccttcgggggtcctcagaggtgctttcagggtcagtgagggccagggagtgcgtttcagatcctacatcactattataacttcctcttttagctgttttatgtactgaggtgcttctgaagatgacttctgggggaaaaaaaaaaaaaacaccctgctgttttatgaagtctgaaaaccactggcctgtaaaaaagagaaggaactttggagtcagagagatcgtgtcacattgcccctctgtcactttgacagattatttaccctttgaatcttaaattttctttttaaatactggaagttttcataacatttatattccattggcttatacagtagtgaaatagtaaagcaaagtctccttagcttgttagggaaattactattcttacatatactaaaaggacatttgattttatttttgaactctgatcatttgttgttttgttttaacatctgtgttcaggaatgaccaatagaccagatctgatagatgaggctcttcttagacctggaagactggaagttaaaatggagataggtaaggagatctgtcactgattgggtgtgtggtggggggagtggaggcatttagagttcattaacaggaacaatgtcatatggtgtagtattttttagaaaaggtttatatcatgagaagtagatgtttacatgcttgagtacctataaggaaaacattaggatcataataatctcctctaggctgggcgcagtggctcacacctgtaatcccagcactttgggaggctgaggcaggtggatcacttgaggccagttgttcgagaccagcctggccaagatggtgaaaccccttctctactaaaaatacaaaaaacttagccgagtgtggtggtgtgcacctgtaattccagctactcggaaggctgagataggagaatcgcctgaatccaggaggcagaggttgcagtgagctgagatcgtaccactgcactccagcctgggaaacagagcgagactctgtctcaaaataatagtaataataataatgataatctcctctgatggtgctttcgagactaggaaaatgcctattttatttttaatttcatcaggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggtcaggaaaatcagctaaacagattataaacattatgccagtattctttctctttcctttcaagcatatcaaggggtagggaaatgctgacttttggtggagaagagatggtaaaaggaataagaattaattgtcaactgctaaatcttcagagtagcaggaaggaagataatgtttgcatctgccctgtagtaaccactgactcatctaccttaggtcatcaccatctgacacagacacgtaaagtgaaaattttgaagaagtgtttttaaatctttgtattgtattaaaagttgtaatatggccaggcatggtggctcatgcctgtaatcccagcactttgggaggctgaggcgggcggatcacaaggtcaggagatcgagaccatcctggctaacacggtgaaaccccgtctccactaaaaatacaaaaaattagccgggcatggtggcgggcacctgtagtcccggctactcgggaggctgaggcaagagaatggtgtgaacccaggaggcagagcttgaagtgagctgagattgcgccactgcactccagcctgggtgacagagcgagattccgtctccaaaaaaaaaaaaaaagttgtaatatgtcagaggaagtgggagtttccacgtactagaattttgggggctgctttattcagcaaatatattgaatagttgatgtgttcaagctattgggctggagacataaagataattgtgaactcttccctcaaggagttcagagtcaggaaaatggacatattttcaaattagtacaataatattgtagttaccatggtagaaatacgtactaggatacttttattttgataaagtgctcttgatcttccatctcttctctcctttaggttttagttaccacctgtagacagatttactgaacatatctgtctcctactttcagatttgtactaaataccctcacctagatgttttatcaggtctcagatttaatattgcaaaaccaaatttattgtcttttttactactttcctttctgctcgcatttccctgtttatcccaatttcccaggcttaaaacatcaggattatctttgattcctggcactctactgtgccctaggtcaagtcacttgccaaattttttcagttctgtcttggcagtgccttttagttctcactgccactacccaccttctctttgattaaccttcctgtatcatatcattcaaccattcagacactttcagtgattccccatcatttacaaaacaaagtacaggcttcttttgggtcttttgggtcctctagatctgaccctaactggcctttccaaatgtgctcctgattattctccacatacttcagccaaacttaaataatcaccggtcatcagacattaatttatttttcaacatctctgctttggttttgttttttttgcatcactgaggatcttcatcctctacgtttacctgtcttttcaaaacctggctcatatgctaccactgtcctcacaccttttcacattttccctttcaagaatgttatacccgtttccttcttgaaatagtaatgtatcatttatggtactgtcagttgactttggttcacagtagatttattcggcatctactgcatgctagaccctgtgctaggagttaataccccgactgcaaagaagtaaagtacctaccattaagctgccctcagtctaaccctccacgtgcagtaacagaaagtacatgcaaggcaagagagtgaactcgtgtcagatatggtcaacttgtggggtgagagaaaccttcatatgcatgtctgttggtagagcagggccttttaggtagagggaacaacatatgcaaagaagcagagacacagaatagcatagtgcgttggagtagtttagtattgcttcagcatggaagttaggggagggatggtagagagattgtgggggataagtcaggagactaaagtagggatggagcacaaagagccttttatactctgctaagaagtatggactttttttctgtgagtagtgctaagccattgagttttaagaatagcagtgacatagtgttaaaacataagatcactctggcagctctgtcgagtggagtagttagaggagtggagttggcgacacaggacaagagggggagcttttataacagttcaggcaagaaataaaagcctgaacagttaggttgagtatgtagatatttgggtatatcctatcactggttctagaccaggaatccagccaactaccagtttttataaataaagggcttttttggaacagtacacattaatttgtgtactgtctatggctgcctgcatgctacagtggcagagttgagtatttgcaataggggctgcatggcccacaaagcctattttagtgcttttattttaggtactatctgccactttacagaagtttgctggcccttgttctagactttaaatccttatcttattcacctcagagtctcccatagtaccccagatagatctaaataatgagcacatggtaggtgtccagtaaattatttttctttttttttttttgaaacagagtcttactctgtcgcccaggctggagtgcagtggcacagtcttcgctcactgcaacctctgcctcctgggttcaagtgattctcctgcctcagcctcccaagtagctgggactacaggcatgtgccaccacgcccagctaattttttgtatctttagtagagatgggttttcaccatgttggccaggctggtctcaaacccctgacctcgtgatccgcccgcctcagcctcccaaaatgttgggattacaggtgtgagccaccatgcccagccaatattttttaaatgagtaaacttacgtaactattctgaatcacgctctatccataagtcataatttccctacataatagaggtggatttgttctagctcaagaatgccaaaggtttggatggtgtgggaatattgtattgggtctttatataatggatccattcagggactatgtttttattcttccttgtttgtttgttttgagacggagtctcactctgtcgcccaggctggagtgcagtggtgcaatctcggctcactgcaagctccaccttccaggttcagccattctcctgcctcagcctcccaagtagctgggactacaggcacccaccatcacgcctggctaagtttttgtatttttagttgagatgggatcaccgtgttagccaggatggtctcgatctcctgacctcgtgatccgcctgcctcggcctcccaaagttttgggattacaggcgtgagccaccatgcccggccatgctatactgttttaataagaagagatggcaacttcaagaaaaatgatgtaaacagtgtgaaaactggtccctaccatactgatctttcatctcagaccacatgggtgcatcttgatgtaatccacagtaactagtttactagttgtcatatttttcatatgtgttggccatggaatttttctcttatttagtcatctgtcattttaactacaataatcctatcccaaaatttcactttaagccgttgtctcagtaagaaacatgctttcttcaagcatatattgggtttatctacatatgaggcaatgagggatggtgggaagatcgcagatatcgtagtcagaaggtgtggttatgcattatatttcttccacctttttgtttctgacctgtcaaggggagacactacctatctaatcagatttttatgagaatgaaagcaaatactttatataaaagtgccttgtaaactctataaatgctagttatctccatttttttaattggctgatttgagaggatatcagtacttttcaatatatgaatttctgatttttattgactctttgtagttacacattttctaattgtaaagctaaaatgtttgtcacccttgtacataatatattatccttctgatttgcaagtaagcagtagtgcaaatagttcatgtttccatcacttttttccacatgatagaattatctgtaagcttcaggtgatatgtattgacttgcgatcattgctccttgtaccaaacagctcctaacttttcaccatatcaatggaataactatgtaggcactttagggatgagaaagctatgtaagacactaaccttacccccaaaaagaaatattactaacatttcatcttctgcattttaaaaaatctgcattgtcagaaggtctttaaagactatttttccaatgactcgtccttggctaaacaaaagaagtacagttttagtcttccattgctatagatgtttgtagctttaatagtgattgatgaataaatatttaaattgaaacttataaagttgttactgaactttaaaacattcaaaacgtacaagtgttatgatgttctttctttgtattttaaaaatccattattggtgttattttgcttccttttcaaaagattgaggcctaaagaaagatttagtcaggtggactaaacaggtctttcctgttaaactgttttttcaggttttctgagacaagtggaaaatctggtcagaaacacctgttgttcatgtcatttatacttgaacctatgattgcggtcaactaaaattcatgtgacatttggttgtttttatcttgaaaggaatttctgcttcaggttgagaagattcataacccaaattttttctctaatctgttgtgaggaaataaactgaggacacacacacacacacacacacactttctctcacatacactttccacctgagtcaaagctctaagttatgtttacagaatttcataaaattatttcttatttttttgcagaatttttgattgattaaggtcattctacccttaatttaagaggaatgataagaactttgaaaggtcagatttaaaaggttatgaaatttaagggtgaccacttgatatttgctagtgttgaaatacaagtttattagtttctgcaggtataagctgaaagatgctgcctcttctatattgattagctgttataaataaaatgcaggaaaaatgttgctaattcaaacaaatgagaaaaggttttctgaaaaagtaaaaattcagaattatagactttttaaaattttacaaattttgataaaatgctaaaagtcagctaagagcagtccttagaaaatttattttaatgagcaggtaggaataattgacaattggaatattgatggcttacaattatgtaacttacagaattccttatgtgcctgaaaacagtttgttttgaaatacttcttccccacacccatcttaattcacttttaagaaaggactcagcaattaattgggtgagtcttttcttaataattagcaaaatgacaagttttataccagcttcagtcctaaaatctatcgtattttttggcaaattttgaaagatgggcaagatttttctttcatactgctgtatgtatctatcatttgaattcggttttactgtaagagaatcagaatgcaaaatattatggtaaaaacctaggcctgtgtaggaaagaggtgtttaaagtgaggctggtagctttgttgagattttaatgtttcggtcagagctcttgtcttccctttggcctgagagtttgtatcttgtagaatcctttcagatgtatcaaaaagtttgaatcagagttaaaacttttatataagggtatctaggaaggaagtcctgtatctgccttttataacttatggaaacccccaggtttgtataagtataaaatgagataatgtgatatggtgaaatgagatagtgtgtatgaacatactttataaactataaagaactgtagacatttgtatattattaattatcataattctttcacggatatgcttgtttcctgtgacaccatttttctttttttcttttttttttttttggagatggagttttcttcttgttgcctaggctagagtgcaatggcgtgatctcggctcaccacaacctccgcctctcgagttcaagcgattcccctgcctcagcctccagagtagctgggattacaggtgtccaccaccatgcctggctaattttgtatttttagtagagacagggtttcgccatgtaggtcaggctggtctcgaactcccgacctcaggtgatccgcctgcctcggcctcccaaagtgctgggattataggtgtgagccaccgtgccaggcccatttttctttttttaaacttagaaatgccaaataaatgcgattaatatttatcaaacctcatatgtgccaatataagccctattaataatttaaatgtttatgtttttttgtttgtttgtttttgtttttgagacggagtctcactctgtcgcccaggctggagtgcagtggcgccatcacaactcactgcaagctctgcctcccgggttcacgccattctcctgcctcagcctcctgagtacctggggctacaggtgtctgccaccacgcctggctacttttttgtatttttagtaaagacagggtttcactgtgttagccagtatggtctcgatctcctgacctggtgatcctattgcctcagcctcccaaagtgctgggattacaggcgtgagccaccatgcccagcccaataatttaaatgttaattgttctattgaagtaaaatatttgtctctttgttactttttactttatttttaaaagtatagaagttatagatgatggctttctttttgtaaaagattcaagaatgtcaaagcatatagggaaaaatgagaaaggccatctctaacaccactttcctttccctctccagagttagccaaaatttgggatatatctttgaagtttgttttctttatataatatttacattcatatacgtatgtgcttttttaaaaaaatgaacattaatggaattatactgcagtttacatttttcacttgcaaatattccttggatagctttctgtgtcagtgtatgtaagtccccttcattattttggacaaatgcagagtattctagaatattgccacataatggaaaatataagatccatgaacacagggaccttttctgttttatttactgctatgactccagttcctcagatagtgcttggtgtctggtaggtattcagtaaatagaattaatgaataatttatttaacatatggattatttctggttgtggctgttgaaaaaatactgttgtgaaaatgcttacttgcctccctgtgcacacaaggaatcattttctagggtagccatccaaatgtcttttcaaagacatggtttcattgtcttctagtttctagtgttgccagtgagagttatcataccaatctcgttctggtttctttgcaggaaacctgttttgtccctcagaaaggttctaggactttctcttcacctttggtgctctgaaagtttacagcagtgggtctggacagatgtgtgcttcttttcatttatcccgatcatcactcactgaaccctttaaactgcagaggcacacctttcttcagctataggaaatttttttctcttctgtcttttattgtttcttctctatgactctttctgttctctccttctgagactcctgttagatcacagttaaaacttatggatatttctttcatgctttgtagcctttctgtctcactttctgtcattttgtgggatttggggcggaagggaagataaataactgtgttctgtttgccatcttcacccagcttcctgccatagttctttttatcccacaaggatgacttttttttatatctgtcacttcatttgtctcacagtctcttcctaaaaaaaatatgactcatatttcataataattgatggaaggttgatatttatttaacatgcgtttgttttatagtcagctttttttgaaaatgctttttttttcaaagccatgataccaatttaaaaattaggctgtgttgttttgtgctattggtagtgagcccagtcgctttaaaacacgtgttggtatcttaatcactcatctggtccaggcagctccaagtgctgataaaggccttgatgcttctccagatgtctaaatgctagctccaggtgcagtaagcagactatttggagctggcacatagattctgaagcacaatgtattaatacaaatgaaagttttaggttcttggtctcctagagtaatggttcttaagcctggttcagtaccagaatcacctgtggtacttggtaaaactataaagaccctctaataggcctgttaaatcaaaatcccgtggggaatgggactgagcgcctgtatatctctgaaggctctggaggttattctgatatgcagccaagtatggctgtgttttcatttctgtatatattttctttttgtatggatttttcactgttcttactctctgtatgtattttttcttactcatgcctcatgagttaaaatggctatacagtgtcccttggtacagatgtgttctaatttacataactgatcccctcttggtagacattattaatatgcttcccatcttttttcataacaagttactttagtagatatacttgtacatataactttgtacacatttgtgaatatatttaggggataaattactagaagtggacttgttcagaggatatatatatttgtgaatttgagagatgtgttttctttgattccaatttttaaaattgttttaaaatgcccataaaattgtccgggcgtggtggctcacgcctgtaatcccagcactttgagaggccgaggcgggtggtcacaaggtcaggagatcaagaccatcctagctaatatggtgaaaccctgtctctagtaaaaatacaaaaaattagccgggcgtggtggtgggcacctgtagtcccagctactcgggaggctgaggcaggagaatggcatgaacctgggaggtggagcttgcagcgtccgagatcgcgccactgcactccagcctgggggacagagtgagactccgtctcaaaaaaaaaaaaaaaaaaaaaaaacaaaaaacagaaaaccataaaatttaccgtgtaaccattttaaatgtacaattcagtggcattaaatacattattaatgttgtgcaaccatcactaccattcatctccagacctcttttcatcttgtaaaactaaaactccatacccataaacagtaactccccattccttcctctccctatcccctggcagccaccattttactttctgtctcttggatatcagctactccaggaacctcatataagtggattgtacagtatttgcttatttaacttagcatatggtcctcaaggttcgtcatgttgcaggatatcagaattttctttctttttaatgctgaataatattccattgtatgtacgtaacacattttgtttatccattcctctgtcaatggtcatatggatttcttccacattttagctattgtgggtaatgctgtcatgaacaaggctgtacagatatctcttcaagaccctgttttcagttctttgggggtatatacccagaagtggaattgctggatcatatgataattctatttttaattttatgaggaaccaccatatttttgttttccacagtgactcaaccattttacttatgttcccaccaacagtgcataagggttctgatttctccgcatcctcaccaacacttcttattttctgcatttttgtggtagtagccatcctaatgagtatgaagtgaaatctctttgtagtttggatttgcatttccctaatgattagtgaggttgaacatcttttcatgtgcttatttaaggccatttgtatatcttctttggagaaatgtttgtttaagttctttgcccattttttatttagttttttgttgttcaattttggcagttctctatgtattctggatattaatcccttatcacatatatggtttgcaaatatttcagatttttttatgtgtgaaaatatgcttttaaatcctcaagagttacgttcttaaactgaatatattcttaactattcttaaatcttggaagtccttacattttgtttttatctcttcttaggccagtactaaagtggaagtggacatggagaaagcagaaagcctgcaagtgacgagaggagacttccttgcttctttggagaatgatatcaaaccagtgagtatgcccattgagtgatatataggccaaaaagtaatgataataataactcaggcgaaaagtaagtgccatttactcagtattatggaaggttatagcatatgcagtttcataaaatgagaaaattttagtattggaaatgttcagtatgagaaacatctgtacaataatcctagtggctggtgatattatttactgaaatattttcatgataggaagcttaccatcttgtaaggcaggccattcaattttgagactttccagttattgttttactttatattgaactagaactaattttcttattggttcttatacaatcccaagctacagaaacctaacttcagtccatcttccatatgtcagttattaggatatttaaaattaactctcatatcctcctctgtctctctctctctctctctttctcttcctttcctcagcctcttccaaggcatccctttttcttgctcagtacatttagtttctctgactactatagtttctaagacttaaaaagtgtcagttttcttaaaacgcactcaaaatggtcatagttggagctttagaatacagtttaaggttattaacccattttcctataaaacaactactaacatttgagtaacttttgtttagagtcctgtgttaatacaaaaacaaattgtagaaagtcccagttcttaaagaagtgtgtgcttttctttcttaaatggacctcaggtccattaagattaatcttaatctttatgacacactgttattagtctgtattttcatggcatgtaaaataacatatggtatatgtagttttctgggacttgctatttattaaatattttattaccaagagtcatctatatcagggatccccaaccctcagtactggtccatggcccgttaggaactgggccacacagcaggaggtgagcagcaagtgagtgagcctcatctgtatttacagccactccctattgctcgtgttaccacctgagctccacctcctgtcagatctgtggtgacattagattctcatatgagtatgaaccctattgtgaactgcatatctgagggatctagattgcacactccttatgagaatctaatgcctgatgatctgtcactgtctcccatcacccccagatgggaccatatagttgcaggaaaacaagctcagggctcccactgatgctacattatggtgagttgtataattagttcattatatattacaatgtaataataatagaaataaagtgcacaataaatgtaatgtgcttgggctgggcatggtggctcgtgtctgtaatcctagcactttgggaggctgaggcgggcggatcacgaggtcaggagttcgagaccagcctgaccaacatggtgaaaccccatctctactaaaaatacaaaaattagctggatgtagtggtacgtgcctgtaatcccagctactcacgaggctgaggcaggagaatcgcttgaacccaggaggcagaggttgcagtgagccaagatcgcaccactgcactccagcctgggtgacagaacgagactctgtctcaaaaaaaaaaaaaatgtaacgcacttgaaacatcccgaaaccacctcctcccccaatggaaaaattatcttctataaaactggtccccgatgccacaaaggttggggactgctgatgtatatgatttcttgtagctagacatcattcattttcatgctgaatagcattccattgtgtgagtaccacaatttatctattttcctgtcaattgtgaatgttaccagtattttgttattaaaaaaagatttgtcgtaagaattcttgaatgaatttctcttatttaggaataaaattattaggttgttggatatatgaatgtcccgctttaaaaaaacatttcccagtggttgaaccaacactgcccccaatactgtgaaacatatcctcttgttctgtatcctctccaacacttggtattatcagatttattttttatttatttattttttttgagatggagtctcactctgtcgcccaggttggagtgcagtggtgtgatctcagctcactgcaacctccatctcccgggttcaagcaattatcctgcctcagcctcccgagtagctgggattacaggtgcttgccaccatgcttggccgatttttgtatttttagtagagacggggtttcaccatgttggctaggctggtctcgaactcctgacctcaggtgatctgcctgcctcggctttccaaagtactgggattacaggcgtgagccactgcacccagcctcagatttaatttttgccattcagttaggtgtaaaatgagatctcatttcagtcttgatttgcattttagttattagagaacttaagcatttctccatatgttaattgaccatatgcatgtattgtgtgaaatagtgtccaagtcttttgcctgtttttctgttgtactgcttatttgattgatacaagttctttatatactctttttttctcaattttgtattgtgttaaaatacatataaagtttaccattgtaatcattttcaaatgtatagttcagtggtattaagtatattcataatgttgtataatcatcaccaccatccatctctaaaactcttttcttcttcttgaactgaaactctatacccattaaataataactcttttttccctcccctacaacacctggcagccaccattctactgtccatctttatgaatttcagtaatcttaagtacccatgtaagtggaatcatagtatttgtctttttgtaactagcttatttgacgtagcataatgtcctcaagggtcaaccatcttgcagcatgtcagaattttcttcctttttaaggctggataatactccattatatgggccaggcgtggtggctcttgcctgtaatcccagcacttttggagattgaggtgggtgggtcacctgaagtcaggagttcaaaactagcctggccaacatagtgaaaccccatctctactaaaaaatacaaaaattagccaggagtggtggcacacacctgtaatcccagctactcgggaggctgagacatgagaatcatttggatccgggaggtggaggttgcagtgagccgagattgtgccactgcacgccagcctggtgacagagcaagaccctgtctcaaaaaaaaaaaaaaaaaatccatgatatgtacataccacatgttgttatccattcctctgtcaatggcagccaggcttctgccacgttttggctattttgagtaatgctgtcattagcatggctgtacagatatctcttcaagaccctgtttttagttctttcgggtatatactcagaagtggaattgctggatcatatagtaattctatttttaattttttgagggaccaccataccgttttccacggtggctgcaccattttacattcccaccagtggtgcacaaaaattctgacttctccacatgctcaccaacaaattattttctgtttttttggtagtagccatcctaatgaatatgaagtgacatctcattctagttttgatttgtattttcgtaatgattagtggtgataagtatcttttcatatgcttatcaaccatttgttacatatccttttttttttttttttttttgagacagtcttgctctgtcacccaggctggagtgcagtggcacaatctcggctcactgcaacctctgcctcccaggtttaagtgattctcctgcctcagcctccccagtagctgggattgtaggcacccatcaccatgcccggctaatttttttgtatttttagtggagacagggtttcaccatgttggccaggctggtttcaaactcctgacctcaagcgatccacctacctcagcctcccagtgtgctaggattatgggcatgagccactgcacttggccaccatttattttatatatatatatatatatatatatatttttttttttttttgagactgagtcttgctctgttgccaggctggagtgcagtggcgcaattttggcttactgcaacctccgcctcctgggttcaagtgattctcctgcctcagcttcctgagtagctaggactgcaggcttgcgccaccatgcccgactaatttttgtatttttagtagagacgaggtttcactttgttggccaggatggtctcaatctcctgacctcgtgatccacccaccttggcctcccaaagtgctgggattacaggcatgagccactgcacctggcctgttatatattcttaacaataattatttgttccaagtatctcctttaaagacaaaagccaatttggttagccctgtctttttattactattgtgacttttaaatataaaataatcattttcaaaagtaactccaagatttttttaacaacaagtaatttggccatgaggaagtgacaactaaaaacttaattttatttattccaagggtctggaggataaaaaaaaaatgaaattatgggatatgtaaggaagatatacacgttatatatcttgggagagtcactgttttatggttcaggcatcttaaagcttctgctgtgaggcttggagtatataactggaaaaattaaagacaaaagccagcctataatttttttttttttttaaatgagatggagtcttgctgtgtctcccaggctggagtgcagtggcgtgatctcggctcactgcaacctccgcctcccgggttcaagcaattctcctacctcagcctcccaagtagctgggattacaggcacacaccaccacacccagctaatttttgtatttttagtatagatggggtttcaccacgttggccaggttggtctggaactccatacctcaggtgatccacccgcctcagcctcccaaagtgctgggattataggcttgagtcactgcgcccggccatgaaaatttcttagaacagccatttagccagtttggattagtttcatcattactttttacactgctactgaatttgccatatctaggccaaagaatgagaaccttcctctgtattcaggaatcaaaggaccagtatatgcaaagagactacgtaaaaagtggtctgaaaaattattttgtggcaaagtaatagagatatgagatcactggatactgtttcaaagacagtattacaaaaacagctttatgtgaggtgcatgttctaaagaactattaaaactattccatacatcaggtaatcaaaagttgaattttgagggatgtgatgatctttaaaaaattgaaattctcaagatacatgatctttacatgtacatgatctttacatgtagtaggttatgttttcctatttattctgttaacctcatgaaaatccagttcaattgtaaatactaaagttattgactacttttggcagctgttttgatgggaggtataacctttgagattaaaagttgacaatgaagaagggtgcaatttaagctccaatatgtagtgaacacaaatagaattattatctgaaataattgcttttatatccttcttattacagctcctcatttctatctcatcctaaatcttatatttacacatataaacttaacattggtgccatttaactatgtcccctaccacaaagttgatgtgaacatgatcttctcattaccatttcgtattctcatgttaatccatagcacctgcagtcagtgttaaggtagcatatttgtctattgcgctgtttctaagtccataatctcttttttcctttgttcttaacagaacagcctcaaactgcatactgttgataaaaataagcacattggaacatattctttctctcaggaattatgagggtttgagtctggtggaatctcagcctagaatccattgtttttattccattaagtcacccaaagcagctttttttttcctattgggaaaaaagttaaatgagaaattatacaagttgttttgctttccaggctttttatattaatatgggatagtgatcaatacctttagcatgtacgaattataactcgtcttttatactgttagtttttaacactaaggctcaaaatgctttagactcctttttcttaataggcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggtgagaatgaatgaggagatggcattaaaagttaaaggaaaaaaagcagcattttttaaaagcccgtaagcacattctagaaaagtgaattctttttcgtttttaaccttgttcttgatctgaaaatagtaatccaatctatgtaccaatattgtgtacaaattaaaattttcttggggtagaatgttagtgaggaaagatagcaactagttttcttgtaggattatatctgtatttctgtggcacttaatacactgaatgatgccacttagcctcaattcaattaaataaatacttactgagtacttgtattttagtcattgaactagttgctggggatacaaagacattcaagtgttcattcagtctggtcatgaacaaagacagtgtaaagaaattcctgactacggtgtatgtgtgtaaaggtgtgtgtgaatacaagtcatttagcataggggtggtcagggaaaactagagatgctatttaatctaggccttgaaagaccagttaggattttattgagtagacagacaaaaggggaaggacattccattcacaaataattaatttacagttataattagtatgacggcagaaaagttcagtgaggccccatgacaagggaacctaactacctctaaaggtctgggggatgagagctccctgggagaaacatattaagccatgacttgaccaatgaggagactctggccagccaaagtcactggggaggatgtttgaggcagagcatgtgaaaaagtcctgggcaggaaggagcttgaaagagaaagggagattatcctgacatgagactgtagaagcagatagaagccagttcatataaaaccctgtaggccatattaaagatttaaactatcttaggggcaatgggaagccatttgtaggattttaagcagtgaagccacatcatcatcactgctttatgatggagaatggattggaggggcaaaaagatacagaagagactaatggttagaagcagttggattagtcttaatgagagtcgattgtggtttgaagtatgtggagtagtgtagatggagataagtagactaattagaaatatttagaagatagaataaaaatgacctcattattattgtcaatcataattatgctagcagtttttgagcccttgctatttgccagtcactctactagcactgtgcacatattatctatttaaaccccacttcagtcctccaagggtagatgctgctgttgtctctattttgtaggtggggaagctgaagcctagaaatatttgttagattggatgtgggcagaggtatcaaacatgaccccctgggttctggcatacatagcccgataaatggtgctgtttactaagattgggaacactaatggaaagcagatttctggaagaaagatgatgagttcagttttgaacatgttaaattcaagggtcatataggagaagtaaatcggaaatgttgagcagcctgttggatatgtgggtctggctagcagtagactcatgagttgccagtatatagactgtggttgaagccatgggagtgaacgaaatcacttacagtgagggtgtgggttgagacgaaaaggaggcctagaacttgtctctgaagcatgttaacacgtaaggactaaacagagcagaaaaattgacaaaagagactgagcaagagtaaccagagaggaaaggggaaagagagaatgtgtgttacagaagccaagaaaagaaacatattttaagaaagaggggaattatgaattgtatcaaatgctcctaagaggctgaaaaagataccaaaatgtttgttgggtttgatgacatggagatcatttgtgaccttgatgggagcctgttcagtgtaatggggatgggagccgtaagatttagtgaggatgggtgggaggtgaagaacaaaagcagccagtgtaaataattacataggcaagttccattttgaagggagaagaaggtgcagttttgaggggtatgatgttcagaaagagttttttgttgttatgtattaaactgtcagatagactagaacatgctaaaacacttttggaaaggcttcagggaagaggaagaagtcgaacatatgggagaaaggaacaatcagtaatgtcatgttcctgagaagatggaaaggaagatttgattggtttatggttgaacgagggacacagcttccaaaacagggaagggaaggcagggatgtctaaatgtaggtaagttcgtagatttgcttgcctttatgagaaggcctgagtctttagaattctaactttttacatcacatttgcttctaataaggcagttttcccctgcccccaatatcagctcttaagattgtctttttttgttagacaaatgatttgatagaactaacaacataagtactaatatgcatttgaatgcgttcttttaagaagcaaaacccttacactctgtatattttgccaaaagtttgaaagattaaggatatgtgagaatgtcaggaggcatgtatttcaccatacttttgagaaatgctaattagttcattaagtttagttgctaataaataagagaaaacatgtctgctgtgaaattgtgtcaggaaatgttaatgagcaactagtcgagacctcagtatgttctggataaaagtttaaacttgttttatttccctttgcttaggttggcttttttcccctgacttgctcatatctttatgcaggccctcctcacagtgggaagactgctttagctgcaaaaattgcagaggaatccaacttcccgttcatcaagatctgttctcctgataaaatgattggcttttctgaaacagccaaatgtcaggccatgaagaaggtatcaagattttactttcattttaatttcctatctcttaaatgtgtgtgtgtgtgcacatatatatgcctttgtacatgtatacatataaacccatagcaactatgttcttctcaagtggaaccaaattatcagcagaatatgggggaagcagtgactgttttagattttctaactttgtaatgtattttattgagtacctttaccttctaaattatgctttgtttaatacatattaagtttcattgcctagttttgtatcaatttgattaaaagagttatagttgaaagtgtttgaataaagtggacaaattcatttaggattttttaaagttctttcattattgtacaaagttgaactctttggggtcaattaagttgaggaagacagagatgtatcaatgggaaaatagtcccaggaatccctacaaaaggatagttttatattaggtaataatcagaatctgcttggtaacttaatgcagttctcatacatcttcctttctccaagtgccactcgtcaccttcttaattaacatggccactttctaccatcagtgaagttagaacagcatagaatagaatcctagagctgaaaagactgtaagaccatttggtccatctctcttacattcaagcaagtgccatgcaacaacaacaacaaaaatcaatgatgaagactctaaatggctgttccatcttacttgttagatcatgtttccattgctattctaattttgcatactgccagtcaagaaattattttttgtatccagctgaagtatttcttttatttaaattctttttttcatgcttgatcttttatagatatgaactgaccgtaagtccaagagatgtgggaaaatcagaatgaggtgaaagaatcttgagaattgaagtgctccctagtaaagacagctcagggttttcttttacattgctcttaggcattcgctttataaagatgtattgtagaattcttcggtgtttctttgggaaagagactgaagaagagaaatagatttaaaagatgactcccaaaaaatgtaagcttgagaagctagtctcttgtttgtgcaggtggcagaaaattgcacagggtacttcagatggatggaggaagccgaacttgtagcaggattccaggcatacacattgaagagtccagagaaatacataaaaatgtttgaaattgagtgtgaaaaggaaatattgccagatgcaaaaagaacttataatatcatagtttattctgtctctgaggtgaaaccaatagtatctgtccttcccaggaaaatctgaatagaataactgggaccagtgatttccctagagtaggtagggctgtttttctttgtttttcgttttccctctgatgggaacccttaacccacttcttctggtaaaaatttaaataacagcccttgaaatctgtagctgttgaatgtcccatttatttattgaatagctaattctatttgcattctcctaaatcatctattcctgtgctttttcaaaagtagtagtcatctttgcagatggtaaattactccattgctttccaccagctgccagcttctacctcagatgtactctgagatgtgggtggatggtcctagtttttctataaagtttttaaaaagtacttcaggcttctgcagatcaaagctactttgtaagtgtgagatattatcatttttattattttaatctcttgcaaattgacttgaagggggaaggtaatatgtgctgattttagaggcttaaatggttaaattaatggtttaataacttattatttaatcttcaaattgttgaagcctttcaaggtagagtttcagatgagtagaaagctagggagtataaaaataagtgtccatacaagcttattcaaaattgttttaattcatgattcactgtccggatcatccgtgcactcttaaaattataaaaattatttctgcttcagcagtataacaaatttatattagaatttttggttttccttgggggaaaaatattattctttgtcattaaagttcagaaaagagaaaggaatgaagcataggtttcttagaaatatattagaaatattacaaaatatttccctgcaaatagttttcacattgttacctaatgataggttgacaaaagcctgaggggtcaaaccagtctaaagatgctaagtcttccaggttgtttttgaaaatgaaatgtaaatgtcattctttagtataagttctagtctacctcccactactgttcttgcccctccttttttttttttttgagatggagtcttgctctgtcgcccaggctggagtacagtggcgtgatctcagctcactgcaagctccacctcccgggttcatgccattctcctgcctcagcctcccaagtagctgggactacaggcacccgccaccatgcctggctaatttttttgtatttttagtagagatggggtttcaccgtgttagccaggatggtcttgatctcctgacctcatgatccgcacgcctcagcctcccgaagtgctggaattacaggcatgagccaccgcgcccggcctgcacctccatttttagtgtgaggatggaaagaagatgttttaattttttttcagagcacaaataatttatagagttttataattctggagaaaacctttcttttgttgttgtaagtgcaaaaattaaggtagctttttctaattacagaaataatttagaaaatacaagaaagaacagaagaaaataacaataaattcatatttgtccttcaattctcttttctactcagacacatgtgtacacatgaacacatataccccctcccttatatattggggattacattgaaacatactgatgtaaacttgcttttttcacttaaaatattatgaacttttttcagtgtaactaaagctaatctgaacattattttaaattaatagctgtctaatatctgaacaatccctttttgttggacaattaggttgtttccaggtttttttcacaattataaataatatatatcaaagagttatctatactcccaagttcattgcagcagtattcacagtagtggaatggaatcaacctgaatgtccctcagtggatgaatggataaagaaaatgtgacacatatacactgtggactgtaacacagccatttaaaaagaatgaaatccttgtcatttgcaacaacatggatgaaggacctggaagacctcatgttaagtgaaagaagccaggcacagaaagtcaaatatcacatgtcctcattcatatatgggaactaaacaattgaactcagggaggtagagttagaatgatggttatcagaggctgggaagggtagtggtaacaaaaataccattaaatagaagtaataagatctagtgttggacagcacaataaattaactatacttaaaaatcatgggccaggcacagtggttcacgcctgtaatcccagcactttgggaggctgaggtggggggatcatgaggtcaggagttcgagaccagcctgactaacatggtgaaaccccgtctctactaaaaatacaaaaattagccaggcatgatggcatgtgccctgtaatgccagctactcaggaggctgaggcaggagaatcgcttgaacccgggaggcagaggttgcagtgagctgagagcacaccactgcactccagcctgggcgacagagcaagactccatctaaaaaataaaataaaataatgtgtcgttcggggagtgggcctggtggcagtggcggtggcagggaaagagttggagcagtgccagcggcaagcgaacaaggtgacggaaatcacgcttaacaactttgacaaggtcctggagcatgatggaaagctgaccgaactggagcagcgttcagaccaactcctggatatgagctcagccttcagcaagacaacaaagaccctggcccagaagaagtgctgggagaacatccattgccagatctacttggggctagtggtgggtggtagcctgctcatcatcctgattgagcagctggccatctttctccctcagagtgacaccagtaatgccccacagacctaggatgcaggcaccacctcagggcctggggactgacagctggtcctgagggagaagccaaatggctgcactggctggttccggtctccagagaaccttggtgtttgctctcccctgacccaccccagtgagtgccaaagggcagccccaacacgtgcacccctgcatttcttgtcatgccacagactggccctcgagggcaccctgccatactggccatgccgggccagccccacctgaagctcagtgaaagctgattaaaaaaaaaaaattatgtatagatcaaaataactacaagagtggaaattgaatattcctaacaaaaagaaatgatacatgcttaatgagtttcacaactacccttatttgatcgttacatgttttatacttgtatcaaaatggtgcatgtactccataaatatgtataactattatgtagccataactaaaaatttaaaatttatataaaaacagtattccataggactaccaaactagggaaattactgcccccattttctcattagatttttcttcactagagtagtataacatgaccgagaatttgggcttgctcagctctccacactgaccggccgaatgaccttggatatgtcatttaacctataagccactgttttctcatctgtcaaatgaagataatattaatagctgcattatagggttatgagaattagatggtaatttctgtaaagtgtcacagtgcctgggatataatatgaaatcaatgaagtgtagtggttatttttacttattattatacatacattttttattatttccttatgacaaattctcagaagtgggattgctaaggtaaaaatattagtattgtaaagatttttgatacatagtgctatcaaaactcttaggtaaaaaatgctcttggttttataaagcctacgccttcagaatgttgtactaatttacacttgtagcttcaccatataagagtatgagtttcttgggattctcacccgtacttgatattattaaaatattttttgccagttggataagcagaaggttggcatttagttatttctttagctacatttcaatgactaaatgctcaaatttaagatttttcaaaatgttttgcaatgacaatagtctgtgaaactgaaaaatatgtaacacattaatttttgttaaagatgtgtggtctgaattagttaattcatagagcatctttacctaccactttattacttaaaccaacaggtaagagttttagtagagagggctgttaggcttgctttaatgagtacatgagattttattataattatactattgcctctttttcacaaatggatggtgctaaaatacgtgaaagtagtttattctcaattaatttaaaattcaccttgtacttctcttaatttgcttattagtgaatcctttctccatggataaactcctcaaaactgctgaagtatgtatgaggtattgtcctcacgttctggggggtataccatatgttccattaagatgtttgaagtattcacagaccttccccttctcccctattttacgtttgcttcccaaacttcattctatttttaaattttaattcctttatccatttttgcatcaatacttgtttaaaaatctattttactagttctattcgtgccattaaatgaacaaaagaagaaagcagaatttgattttaactaattacctaatcttgatgctttctgagtatacaatcagtagagatgaagtagaacaatcagatagaactaaattgtttgaacaaaattaagtaaaactaccagtgatttataaaactgtacccattaataacatgatatagtcttattttcaaaggattgaaaattaatggaagaaattttcctttccactagctttgcacgaaagaaataatcttctttgaatatcctcctgtaaatcccactgcaaattgtagtctgcacagaacagaatcgtgatgcctaatcctcctcttttcatggtttagtctatacaaagagcagagctggaaattggatcttttgacagcagttactaagcaacagaatttggatgtttttggttaacatcctaatatataatgtagctgatttgttgaagtttttgcatatattagctgagagaagtgggcactccggaagtgactacaggtccctgtatggctggggaggtgggcatttgttgttgttttgttcaatacactgtgtcttttggcatttgtatctctttggcgtagaaaggaggctggtgcagaactttcagaccttgtgactttttatattattaagaatacccttctctgtggctcacgatatgagaaaatgtaagattttttcctgaaaagcagggagaacaaataaaggattttaaggtcattccaggaagctttagagctttgccaaaagtttaggtccacttcctgaggcagtttcattagcagacagctaatgtttgcttggtctactcccaagttatttttagaaacgagattattactgatagcacccatttgaatttgctcatttacgtttttatatgctaccaaatatgattagagtatgcttttaactaatcgctgacagatttactgcattagggattttctaagctatgagattcctacagtcatcagatttctactaactaggtacttcacgccaagtacttcagaactgagatgaactctttcagctcccagaagaaccagagtgtttggctttgcttacctaagggcactaaggaggtcccagaggatggagggctgaatctcctgagagcatgcttgttgtggcttgtgatcccgaaaggctgggattaatggaactaatgctggtgtgctcccatttgcacttgtgtagactctggagcccgtagctgctgcccctgtcccacacacaggtggctccccagttgtctgaagatcccaggagtgggctctgggacttaagagcttgccgtgtccttgagcaccacattcagacctgcccctaatccctgcgtggcagagccccgcttctcctgtccctcagtgctcacggagtgcatgtggcacactcttgccttaagcccaggctccccacactctgggttgtctctcatacccctccagcctgtgtcgtacctccacctttgcatgcaagagaggttacagtttaatatgacaatctcattatgtgcacaggtggacataacgggcttctgtgttttctagagctgctcttccttcctttagagtagacttcccgttatttcatgagacacaggctgactgatgccactctttcccacattgtttccttcttcagttcttcctgttttttctttagccttctctttcagacttccctcctaactttaagaccctatatatgtatgttgataattttacctgttctacaggaaacttcataatagaactgggctgactatacattctttttctgtgtgtgtgtgaatatatactttttatttagccatttttgtttacaattgaaactctgggaattcaaaattaacatccttgcccgtgagcttcttatagacaccagaaaaagtttcaaccttgtgttccacattgttctgctgtgctttgtccaaatgaacctttatgagccggctgctatctagtttgacggggattctcttgcccacaatttcgcttgggaagaccaagtcctcaaggaaggcatcgtgcacagctgtcagagtacggctcctgggacacttttgcttattttttgtacggcttttttgagttggcttaggcagaattctcctctgagcgataaagacgacatgcttcccactgaactttttctccaattcgcgtactagccggacttggattttctggaaagatttcagttgaggaacgggaacaaagattatgatagctttccgaccaccaccaacttcagtttccttggctgccgtaatattcagctccctgagctgagccttgaggtccgagttcatctccagctccagaagagcctgggagatggccggactcgaactcgtccggcttctcgccattgggcttcacgatcttggcgctcgaactgaacatggctttctcctgggagaacttgcagcgcctgcttaggaagagacccaaatctcgcgagagcacgtcaaaatccctacattcttaagattaattttggggggagtctgtaagatacggttcttaccttcttacctccagcctcagtcctcctggcatcttctgtgttggggcatctttggatctagagcaagcactgtgtgacctgctgtgtgctataactcacggtgagtttggcacttcagttgtactagtctggctagggcagtttgtacaattttacttttctcgcatctttctttccagtacctctcctcctgctgggatttatctacctaaagttgtggtgcagcttcccggcttagtatgtaaatatctcacttggattttcctgtggcagctaacctcacgtacttgccagccaactctgagtatcttcttagtgagaattctgctggggcctgggccagaaagggtgaaagggactaagggactgaggagactaggcagaaatcgtggatcctgggaagagttatgagcacaggttacactagtgactagataaggaagaaaatgtacatgtgagaagagaaagggatgtgtgtgtatgtatgtatttaaattagagcagagtagctacccggaggagtttcagttgactggttacctgaaactagtcaagttacaactggaattgcacagccttcgtcatggtcggtgtgttaatagagcttgctgtgagtgcacctctccctctgatagtaattagcacagagaccgactgcaaaaaacaagaacgtcactacttgatattaagtgactgctgcaggtatttttcctctcaaatgttatgtgtaggccatgcagtcaactgtgaagtgatttggaatgctttgtgaattacagtgtctgagataagttggtgagactacataccatgtagcaagtcatcattagtttagacctaagcaatgtcctgagtaaggtccttgcagccatataagctgtacattgttttgagaaggaaaaacatagaactactgcaaccagccaggctgtggtgttccaggtccctgtggctctaatccatgatctcacagcctgatggtcagagttatatgctggcatcagagcttttagtagaattctgaaaaatgttttgaaaagcaaagcattattttcagtgattccttaaaattacctgagtttataagataccacattggctgcggttccatcttcaaaaaaagtagcaaagaaccgctgtagaactgcttctgagcttttcagttgtctcgaatgtaccaactcaaagccaaaaggaaccatcattgtgtatcaagagactgaaataaatatcctattctcattttctctttttctgtgtttggggaggagaagataaaaggcccttcccttcttgctctttaaatgtactcatgatccattttcaaaccagcttcacctctgtgttttatttcagttgccaaatcaggacagatccttgactccagttttctctttcatcaccacacccattcattcaccaagttctttcagttcctcctcctaaacatctctagattctgtccacttaccagcacacccactccctggccaccatcatttctcacctagaactccacaatctcaattaactattattcccctctaatgcttttctatacaatcaggaaaatgtttctaaaacataagcctgacatgtcagtccattgcttataaccctttagtggcttgttattgcctttacagtaaaattttaactcatgaaatttgtaagactctttacgtccaagttccttcatcacctcttctaattcatctcacctaccactccactgcattgacaccaacaccactttattttaattcttattgaccgttcctgcagtgttcctgaatgttcacatctctgtgtctcctaattttcagtatattctgcttagaacactttcttccaccctttccactggttaactgttgttcatgcttcaagtctcaggttaagtgtcacttcctaaatttaggaaactgtcctgactccctaagtccatttaagagtcaagataggctgagttatgctgcatgaaaggacaacccgaaaatctcagtggcttaacacaacaaagtttattttttatttacactactatatctccgtcatggctcagacagtgagttctgttcattatattttctcagagactcaagctaatagataatagaggccccgccttacatctgattccatgatagccaaggcagggaaaggagtatggtgaatcatgcagtgactcctaaggcttctttcagaaaggggtgtatttcccctcatatttcattaaccaaagcaagccccatagttatgcctaacttccaaggcactggggaaatactgcctaccctgtgcccccgtatcatcttgtatttcccctagcctaataatgtcatgctttgttataattacatgtgacttgcttccccaactctaacttttgtgaaagtaggattatttttgtcttatttattatcctctgcagtgccttcattaatgcttgatacataataagaattcaaaaatatttgttgagtgagtgaatgaataaggcagcactccaagactcaatccttaggcctttttttcttcttcttctgccatttcttcttgaagatggcttcctctgtcatggtttcagcagtcactgccctgagagtgatttccattccctgacttcaatcagatatctccaacttctcacttaatatttctacttgaatttaaaatgtgtaaatttattcttttagtaaatacttcttaattactctctaataaggcattatattaaatgatatgaggatacagaggtaattaagacagcacttgccatctgagggcttgcaatctagtataatacaaaaatagtacaatgaatcaataatatatatacgtaatatacaaaatcctgtgccaaaggagaagacaagtgatttatggcaagatggaattggaacttgtgttgtttcaaccattgaacctacagagcagacatcattactgaattctgttctgtgctgggcactacacataacatgaacagaataaagcttttatccacctcacagtccagtggggagacagatagcttaggacgaaaggatagatggggtttagacagagtgtgggagggtaattagggggtaaagggatggtgcataggaaaacgttttcaccagaggggttgacctgattaaatatctggagaaattgtcagtatttatgccaggaaagaggtaaggaaggaactgaatcaagatggtcacagtgagactctattatggtaacttaattgttaggaatactttaaaaaccaagtatacacaggttgtttttaaacctaacatgaaaaatggttaatatcatgagtttgactttatttctgtacctaattataagtcttcaatggttaaaagatacccaggaaggaatatatgccattccaagcaagatgttggtgcgggtggggatcgggtttactatcttggtgtactgaggttggttaccaaccagagagagtgggctgggatgcagaaactaattcttactcatgacactgatgagatttcctgagccccacctgtagtctctggaatagtaccttcatttccaaaaaggctagtctcaaggccttgagtacttctattcaacttgcagataagctaattcttctatctgatttgaaattactacatccttgccaggctaaaaccgttccttcactgcttaatttcattctcattttcttgaccatcttaagacagtgcattcatatcttttgtctggttttatacgtacatctatctgatccttcatactcaacctttaattcttttgtaagctcttttaccattatggtctgatttgagttgacagaattctgatctttcagtgttacttttgcttaacagagccacaattcttatagataataaaatggcatctagttttattttacacatctcttgtggctccatctagctcttgagtcattacactaaagtcctgctcctgacacagataccagagaccagtgtgatagaagtgatgggatgtgtcagttgattaatgatcagctagtccccagcctgcccaggtgtgacacacacagctgttagtgctgaaaacagccttagcctgctctctgttcagcggtgatccagtgtgtcaattctaatttattgtagtccaaagtgttggtgttttcctgtgctttgtttagtattgctcaagaagtaactaaacttcttggaaattgtcgtaactgtggaggacagtgagataataaatgactttgttttctttcagatctttgatgatgcgtacaaatcccagctcagttgtgtggttgtggatgacattgagagattgcttggtgagtcctaacttctgctgttgtattatctttgccacattacagctaatatctcaaaagttacaagagaaaattaacaagtatttataaactgtaaagcaatagaaatacctttctttgtcttacaaggaaatataatgttctctcttaaatagctgacatcaatgatagtattcattttaatatgccctgtgactataacaccattataaactgctttcttgtaagggcccatgtctcattttgtatcttccagtgtgcccttgccatagtaaatgattagtaattttcattgatgagtatatctgttatttaggacctctgagctcagaaattcacttgtgaactttgacagaactaatgaaagaagggtttaggatcacagagaaatctgcaaattcactaaaacactaagggcagaagttgtaagctctctgcacctcagtttctgctcttacaaaacagagactataatccctctcttgcttatcccacagagtaattgtgaagacaaaaatgggataataaatcttgaaaaaattttgtaagttaaaagtgcagtatagtaatttttaaaatatgtattaaatatctcctgtgttgaagtgcactcctacagaatacaaacatgaagaagacttggtcctggcacttaactcataagaaataaactgcaaggaagggccagaaagttgttaattttatttcactgtaaaattaaatcagtctgacataaattcattacaacaatggctcaggaaggggtaatacactctattgaaatggaaacccacctggtgacttaataacatctgaaaatactacccagtgtctgaataatcccttcttctttaagctgtccataatggtgtagtcgtgatttcaagctaactgttcttactgcatttttcccatgattttcagacctgcttttggtcctctgttatttatttttttaagttttggcagtgtctgttataaagcaaagcaggtatatctgtgaggtctccataaattgatagtgggttttgggtctgctaggtttgatacatctcagcccagtttatgggatgatttctttaaaagcttttaggcacaaactcatagctctgtgtaaattcctttatcttaacacaattgaggtgtgtggtcatagcaacactaccatgtcaggaatgtgtgccctctgagtacatttcactggtatgaatagttatcatctgtgcatgcttgctcatttattcaataagcacttgctgagcccttcctcctctggtagaagtattagagtctcagaaaaagacgctgctgcctgtctttataacatatgttggcaaatgttaatgcaaagtagaatgtgccatgtattttggatattctgtttttttttttatttttattttccctcccactgttctcatcaggtggatagtctgaaaatggagggatcagttttgacctcagggggcctgcgagtagctctaagcccagggcagaggtgcatatgcagtatgcagagaaagctaagcaggtggcatttacgctgaatcttgaattattggtaaatgtttaacaggtcagatgttctcttagaaagttatctgttccttaccatctgagggccaatcttagtggttctgccattgtttccgttttattgaaattccttattttcccctttgcccattttctaacatcatgttttaatatcagtgtactgaatggccatggtttgcagtaacttcttagaaatgcttggtaaatacacctggaatttttttttccttccaaaataatcccagaaaaaacatctacatgaactcaaagtgaatatttagaagctttttcaaaaaatttatagagccgagtacagtgggattatggcaacctataatcccagctacctgggaggcttaggcaggagggttgcttgagcccaggagttcaagacaagcctgggcaacatagcaagaccctgtctcaaaaaaaaagttacagataagagttcttatattttaagcatttaggttattagagatattttttcttattataaatagttttatgactgttatttaagactgtttactctttaaattttttttttcttattctatacatattctgcttatgtagggactgtgtttacttttgatgcaaaaaaaaaaaacaaaaactgaatgtttggaatatgtacatgtgtatcaaatccctaaacataataatgtttcttttccagattacgtccctattggccctcgattttcaaatcttgtattacaggctcttctcgttttactgaaaaaggcacctcctcaggtaaaataatactactaataaggaatattttaacaaagagtttttcagtaaatcgcatataatgatacaatctttaaataagcaggttatcataaacataaaattctgttgttgaaaggattttgaaaggtcgtccagtcttgacttctgtttaaggtaaattattttatcaacagaatttttccattccttttctgaagaaatcaaaatcccacagtttctgtgtggaatacaacaattagcattgtattttgttgttttgtaagttttccaccatattacatatccctactacctccaactgccaagggagattatgatattaatagagaaggcattgaatatgttcccatatgtttcatttataatttcatgggttttcctaaaaatttgtttatggggatatttaagtttattttctttgggcagttaaaaaactatttttaacagatgatcttgagttatttttcttgggtcatgtggcacttttgaggagtgaatttatagccaggatcttgattcctgtgtttgcatttttactgatgtggctattagagacttgtgattttggtaggttaacaaatttaaaaccaacctatgaaggttggttaaatatgttaattatgtagaggctgccagagcatgtttggctgtgtcacaagacatgagttctcttgattgattctgcatgctgtaaccttgaaaaatgccaatcaaaggcaggtacaaagcagttaagcactgacttgaaaagcatcttaatgtctgtatgagaatctcatatttaaagttagagatagaaactaatctgtaaggaaaatatttactcttaaactggtgaatctaatttttaatttaacagttatatatgtgcgtgtattttgcacttaaaagtaaatgacttgtcttggtttttctggagtttttttttaacttctaaaataatgaaaagaaacataacctataatagtcttgaagatttgcaacatatgtgtactgtggaaggatttttaaatcagcttttcataaaccatcattcctagtaattggagtcttagcttatactaagggtgaagttagagaggtgagtgtattttccctttctctgattcctgcaatattttcttaagtaagtaaacgtatatatctaaagttgctgaaacagaaataattatctacatatatcatgattcctccaatgttttcataaataagtaaacgtatatatctaaagttgctgaaacagaaataattacccccaacatctacatatattatgcacacaaaaaaactttatgtcagcatattaattataaaaactattagaatgtgagactttttctaggcatttaaatttatctcttaaaatagttcttcttttttagctgaaaataatttatgctaaaagtcacttgggagaaggaagattaacttcagtgctatcttatacttcttgttctttacattgttaaatactatacacattgatttaaacagaggtacacccccttggctgagaagcatttgtgatccaaagtagatactaacagaaataaacagaaactattaacgaatgatctgccacactaagatttaagaataattgtttctgtgttgtaaaacttattgtaagatttttgagggaaggaacattatcttatgcttttaaatctcacagccaatggcatagaggcttatacgtacatgcttcacaaataccttatcaacaaaaaaaaatttttcagtgtcttttcattttagtgggctcaagtgttttcatattgctggagtttatatttagacaggatatgataagagtgaaaacattcaaaaataagtaaagttcaaatggccaacaagtataagaagaggtactcaacatcattagtcatcagagaaatgcaagtcagaaccaatagtgagataccactcattgcatacctgctagaatggctatcatcaaaaagtcaggtaatgacaagcgctggtgcagatgtggagaaattggaacctgtatgcactgctggtaagaatgttcctcaaagaggttaagcatagagttaccatataacccagctattccaccaagtatacacctacaagcaatgaaaaacatatgtccacatgaaagcttgtatgtgagtattcatagcagcattattcataactaaacatttatctgataaaatctagtatatccatataatggaatattactcagcaataaaaaaaagtagtaccattacatactacaacatgaatgaactttgaaaacatgctaagcaaaaggagccagtcaaaaagaccacatattggatgattccagttacatgaaatgtccaggactggcagatctataaagacagaaaatatatttgggatggcctagggctgggaggggagaatgagaagagtgagagggtcactgctaatgggtatggggtttctttttggggtgatagaaatgctctaaaattgattttggtggtgttgtgtatatctgtgaatatactaaaatactgaattgtacactttaaatgggtaaactgtgtgctctgtgaaccatatctcaagcgattacattttttagaagtggtttaggagctacttaaatgatgaaaggagacatagagttagaagtgaggggtgagcatccaaggtacgtggcccagcttgggagaaagaggaattggatcatttaaaaagaacatggagtgaatttatctaaggactgaagaggaagaatatagaaatatgtaagaagtaagagatgtggttgccttagtgattggaaatggcaggggttctctctgaagggaataccatctggtcattaatctgaatttggtgactctgacctggactgccagattacctgcagtatacatgaatcagtgacaggataaattaatatttgtagtatttctagttggcatgtatttaacaaaataaaaatgtgctttgtcataccaccttgctttttaaaatgtttatattctctcaagaaaataaggggaaattttcaggctgatccaagtgttaagaatattagtcattgtaaaatggaagcattcactttgtcaaaccattagcatatagttttttcagatgtttttaattaaatattaaaggtatattcagctaaatattgtagaaatgcatagagtgatagaaaaatatttattactggtaagaaaacaaaagttgtgagcatttttctttaaaaggaggaactatacttatatacactacagtaatcatatcagtcacagaatcctcaattttgcatttgttgtatttccagctttcacacagaaaaattgtgtgtgcatgtgtgcacgtgctcaaataaaagaatcccttcaggggcactatgttgttatgtatccagatattctcttttctccttccacccctcccccaccaccccctcccttcttgtaaattggcttattaaaactggttcccaagccctccttttttccctttgtgattgccttggtcttggattttcagtgtagaactaaaaattcaagtcagatttcagttactaggataattttctttgaattttaaatttttctaagtaaatgcatagatttttaatgaacctggtattcagtggatttgctttaaatttagctgcagagttaatttcatgattgatttattagccctttgaaagtataaaaagtggtatctgcagttcgtgaagagtgaaaaacatcatcacattttgtttagcatctttttaaaaccaattaaaagcttttctaaaatggattgaacaggagaaaataaaacatgttccctaggtctttatttcaatcaagtttccctgtgttctgcaggagaagagatcgagaggggatagaaaaattgaaaagggctgtcccagcagggagccaagccggaaaaaagggcttctctgagaactcagcagcagcagctaagaaagctcccagcctgcttcatctacatgcagagtcacacaaggcatgggggtgctcactgtcacacagaggtttcacatgtgcttccctgctgattcctgtgaaaagctaacaattggcttggagggtaaaagaccactgcagttcaccctccctgagctggacgtacaatttgtccagtgttaggaaatgtccggcttagcagtgagaggcttgaagacacccctccttccagtgagattcctaacgccgtctcttttacttgatgacactggggctcttttcaagttttgcagatttatggaagttgaggggaatgtgcttttcaagatcaggaggatgaaagccttggtcttaatgtcaaggaggaagcggtagtgagtggtaaggccaggtaactcttcctgcagcctgcaggaccagtggcttgatttttcctcatagatctcttctgccaccttcttttttttttctttttgggagacagagtgtctgaaaaggaactccttgggctgtaaaatgacatgattccccagtttcctcaacaagtgtgagagtagttaagcctattaacctcactgtttaatgctgggtttgacacttttgtgcatcaaattggaaaacctcatctgtatgtaacagggtagcctcgtaatttatggaggagcaatccttcctcagttcagtgcttcccaacctttttagattatggtgcatacaaaatgataacatctgatgatacacttgggtaagtggatgaggccactcacaactggccagggctctagccttcccaacagctggcaggaattgatatcttagtccaggtataactcatttgaagctcaacgattggaaaactctttggaaactttaaacttttacaaaagaagaattaccactccaacgtcatagcagtattactgaagtagaactcagacctaacagttattagtgttctggctaaattttatgatgttgttgagaatagtaacttcctcgctgctctgacacctaggaatattacctaataagagagaaatacagcttaaagcttggaggacctaaggtgtggaccaataagaaactgtcagcattctcaggatggggacttgggtagacacacttgtttctgcatgagttttgtttttaacatcagcagtctctagacaacattgctttcatgtagtccttacatgacatcttagcagtcttacttcagatatggttataggacatcttggtatcttgataatattaagcaactctttaggctttgggttgctttagtgaaataagcagataatggaagagactccaaatcatgcaggcctaaacatgagtatctctccatctatttgttcaaaattaactctggctaatgactatgatatgactcaataagatatataaccactttaggaaagaggcttagtcattttgccagacacattaattttaatccactgatgtggtgacttttgcattgggcttcatttcttttatctaaaaaaaaaaatgatgcttgacagtttagtggcctgcttagtaagtcagtgacattagatacctactatatttataatattctctttaggtatactttgcttagtatagtagattttcttggaaagtcctttgtagattgaacatgtgtgtgtgtatatatacatatctctgaggacaaaggaaatttccagagatctgtgttcttgttttctggacagaaagataatgtatagtgaatgtatagtgatcaactaagataatgcctagtgaagccctttgtaaacctgtggactacatagatagacagtattaaagaacatatatatatagtacatatatatgtagattaatttcaaatgtatcaaaaacagtgaaataggccagacattgtggctcacgcctgtaatcctagcactttgagaggccaaggcaggaagattgcttaaggccaggagttcgagaccagcctaggcaacatagtaagaccagtctttacaaaaaaaagttagtcgaatgtggtggtgagcatccgtagacccagctattcaggaggctgaggcaggaggatcgcttgagcccatgagttcaagaccgcaggaagctgattcttaccaccgcactctagcctgagtgatagagcaagactctgtctctaaaaacaaaaccaacaaaaaacagtgaagtaaattattttataaaacattgctacagatatctgctgaataaaatcaaattttcaaaatagggttttgttttggttttggtagagcacatctatagtagatattaataccagaataaattataagatatatatgccattttctgataactcaaaattaaatatctaaattttaatcatcagagaaatgctaatagtgttgagacgaaatattttttcattgctagaatgtattcttccagatccattgccttaaataagttactgtggcattacattagcttttgaaaggtggggattataacgtcgtagtagtccatgggtgccatgactctagttaagagcaccctttctgtagaacttactctttgtattgaacttgaggtttaaaaaaaaaaaaaagaaacctatgtcttagctcagatatcatctggcattatagccttgaacgtcccttaatttcttggtgtctatttcttcatctgtaaaatagagataattcctcatgtgttacctactctgttgagggtcagctaagataatgtgtagtgaagccctttgtaaactggtggactacatgagctgtccaggcgcagtggctcatgcctgtaatcccagcactttgggaggctgagacaggtggatcatttgaggtcaggagttcaaaaccagcatggccaacatagtgaaacccgatctctactaaaaatacaaaaattagctcaacgtggtggtgtgcacctgtaatcccagcgactcgggaagctgaggcaggagaattgcttgaacccaggaggcggagtttgcagtgagctgagattgtaccactgcactccatcctgggtggatggagtgagactctgtctcaaaaaaagaattgcctttggatagtccacagaaccttttcagcttgtaagataggaaaactgaagaacgtataataactgctatatagaggaagtttccataggaagtgagttcagagctcccactttggaatgcctgaacccaacttccctcatttgcagtactgggaaaagaaacctgcttccccatctctcattcactgaaatttagaagcttcctacatcctaagacaaatactcttgtctggggattagggattcctgttgtagaaagaagtaggaagtggagacaggaattgccaagatcagtaggccaccaccaggtcacacttgtcttcagcctccagggactggcccacctgcttcctttccctgccaccacctgttgcttgtggctgaagttccccttttctcctaactcatggtgcaacaaagtggtgcttcacagtttctttcctacctttctgtcccagaaacaagaatgcagatctttggagatttcctgtgtccttggggatctcacaatggccagaagccctggccctccctctactccttaccctgttaatcttggatggtaggattataggtgatttcttttttattttgctttattgtttcctgtactttatagattttctacaataagcatatgttactttgataatcaggaaaaaataaaaaatgtgtatacaattatttttaacttagcagtataactgtcaaaaattccttaattccattgctttggtactaatttgctgctaaccactagggttaaatgagactacctttgtatctaagcttgtctatgtataatatatttttaaccttgttctttttatgacttaagatttaattgaatatctgaaatatgctgtgggttttggagtaaaagtgtgcaagtgcctcctaactctcacagttgtcctgggaaacccacctggcacttggctcagtgccatgctccccatctaaacttaccatggttgaatgccagtgtgactaaagttgaccaaggtagatggtaacgattgtcttaagcttcattgaaaggagatcggaagtttctttttcaccaaaaatatttcttttgacatagaagtttaaaacatttctttaaggaacatctgcttttattagatgtacatttaagaaatccttctcagtatagagataaaaagatgaataagacattgtacctgccctcagatggctcatagtccaagaacactgttcaattgtgaagtttgtgcacaaggtgggcacaggtcaagtagcaaatgaaggttaacatccagcccacatgctgcccaccaaggagtccaccctggtttgggactgaatctgccctgagtaaggttaccagatttagcagataggaatataggatacttagttaaatttaaatttcagaaaaacatcacataattttttagcatcagcatatcccatattttggtcagacttatactcaggtatttctctagcaaccctaacgctgaacaagaggaagagggtgccttttagctcatacgaggtgctggggcttggggaaggaagcaagggtggccgcactcacccagatgattgcttttttctaatttgttcacctagggtgtgtgtgcgtgtgtgtgtgtgtgtgtgtgtgtgtgtgttttctgatccatgcagaagctaactggtgtccctgtcacaatccagggtgggagaaagatgtgaaaacatgatgcatagagttaggttttatatgttacgtggttccagtggaacataaaggaaagtgtggtccattttacctgagaagatgtgcaaatcattcacaaatagtagtttcggatcctggtcttgaaagatgagtaaaagggagatttagtcagggccattgtgccatgctaaggaattcaagcgctgcagcaatggagagagaaggtgaaggatttatgtatgctaaaattagcatattattattattattattattattagagataggatcttgctgtgttgcccagggtggagtgcagtgacgcagtctcaatcactgcagcctttacctcctgggctcaattgatcctcccgcctcagcccctggagtagctgggacaacaggtgcacaccaccacacctgactaatctttatattttttgtatagacagggttttgccatgttacccaggctggtctcaaactcctgggctcaagcagtccacccacctcagcttcccagagtgctgggattacaggtgtgagccattacacccagcctaaatttttttaattaacgtacaatatgatacttgagaatttgaggatatgttctgtgtacttatcttaggcttcatatggcatagtttcactggagggaagaatagaaattcataagaaattataggcttcattttttctaagtgactgaagcttaacctctttaaatatcaattattatactttagccttttttaagaggaaaaaaattgctacatacattcttagtgtctgaagcaaagtataataaactctatgttaatgaataaggaccatcataacaaaccataattgatgggtcagtattttcatgggtgggactcagcaggaactgttggaatatacaggattccgtcctggtgcctgttaggtagatacggtgtgccctgtttgttgagttttttgtaccttttctttttttagtggttttgctatcagctgttacttgcagaatccaagtgagttgtgtcagctggcctgcctctgatgactcctttttccagtgtgctgctttcatctgctataaattaaggcaggcaaccaccaggattcatgagctgttcatacagtaagagaactaaactgtggttgggcgcagtggcttacgcctataatcccagcactttgggaggccaaggcaggaggatcacttgagtccaggacttctagaccagcctgggcaatatggcaaaaccccatctctactaaaaatacaaaaaagtccaggcacggtggctcacacccgtaatcccagcactttgggaggccaaggcaggaggatcgcttgagtccaggacttctagaccagcctgggcaatatggcaaaaccccatctctactaaaaatacaaaaaagtccaggcacggtggctcacacccgtaatcccagcactttgggaggccaaggtaggtggatcattcaaggtcaggagttcgagaccagcctggccagtatggtgaaacccccgcctctactaaaaatacaaaaattagccaggcatggtgacaggcgtctgtagtcccagctactcaggaggctgaggcaggagaatcgcttgaacccaggaggtggaggttgcagcgagccgagatcgcgccactgcactccagcctgggcaacagagcgagactctgtctcaaaaaaaaaaaaaaaaaaaaaaagccaagcatggtggtgcacacctgtaattccagctactcgggaggctgaagtgggagaatcacctgagcccaggaggtcgaggctgcagtgagtggagatcatgcaactgcactccagcctgggcaaccagagtgagaccttgtctcgaaaaaaacacaaaaacataaaactgggctgcagtgagagctggagaggccttccagagagcaaggccccattttgactcctgtgggccccttcctctactaaaaaaaaaaataaattttccacctgttggtacaaagctgaatatattactatattaatattttcttccaccaaaaagttctttttttctgatttttttttttccaggagtgcagtggcgcgatctcaactcactgcaacctctgcctcccgggttcaagcaattctcatgcctcagcctcccaagtagctgggactacaggcgcacaccaccacacccagataattttttgtatttttagcagagatgaggtttcaccatattggccagactggtctcaaactcctggcctcaagtgatccgccctcctcagcctcccaaagtgctgggattacaggcctggcctgattttaaaagaaattagaataatactttcatgggttcctcaaagtttcataggccctgggcactgtgtctagtgggtaagttgtccttgcctgtcagttttaaagttacttgaacctcacattgttttttcagtactaggagtgagaggatttttgcttatttctggttcttggctgtgctctggatagttgaaattgtttagcagattggcctccagataagtaaggcattattattggatatagtaaattcatgttctggaagtttggggcctaaaggagcaatgtgggctctgtagggttaaatgagggcagggtatggtgagaaggcaaattttgaaacattgtgaacataagagacaattgcaaattggcagaaaactggagaaagcattttaataaacaaatgctatggataaaaatcacagaggtaaaaattaaattagaaaggagaatattgacctgattagaacacaggggtcaatttagggtatatcaagctaaaagctgagataggtagggaaaatctactgtggatataagagtggggagtttggatttgctgattaatgtgtggtcatcttagttaagtttctaatgagagagcatgcacagaacccttcctttaaggtattaagaatactatggcatggtcagtacaactttatctttttctttttttttttttttggacaccaagttttgctcttgttgcctgggctggagtacaatggcacgatttcggctcactgcaacctccgcctcctgggtaagagtgattctcctacctcagccccacaagtagctgggattacaggcatgcaccaccacgtccagctaatttttgtatttttagtagagatggggttttaccatgttggccaggctggtcttgaaatcctgaccgttggtgatctgcccgtctcaatatcttcttaatttatttaaccttttctcctaagagcacagaggtcattatttctaggtaataaatctccctaactcaaattaagagatcagccattgctgatatggggcttgtgggggcaggggcaagagtggaccccaaatctagtttaaaattacacaaataaaaacagtagacagcaaagcatagtgaaaatagcaatgaggcctgaactgtagtttcagctccctcactggacatgagagcctcagacagatcactttacctctcaccccaggtttctcatctgcaaaatgagacagagaatgagggggtttgggggaatgaggtaatctttaagagctgctcccaatgtaaaatctgatgattcagtgtctttttcacaaattggaattagatatcctttaatatcatgaagtctgcttttgcctatagtattttaaattattaagggttcagtttctcgtttcatattcagtctgtatcatgaattcccccccttattgtcttctgtcctgcttgcagcaccatgaggatggttacaaagaagtagactaagaatttgcttcagggtaaaatctaatggagagtttaagtgtagttgcctgcctagttgtggcatgatttatttgaaacatccttcctttggtattcagcttaaacatttaactgcaaaaaaaaaagaaaagaaaaagttacaggcatttaaacaagagaaatcagaaatgcatgcaaagaggcccaattcctctcccttcacttgtctctggttgcttttaatggtagtcgatcttttcccttggtttggggaaaccaagagttgtaggagatgttaatagtacttggtttttgtttttgttgttgttgttgttttgagatgttttgctcttgttgcccaggctggagtgcagtggcgccatctcggctcactgcaacctccgcctcccaggttcaagcgttctcctgcctcagcctccttagtagctgggattacaggcatgtgccaccacgcctggctaatttagtagagacagcatttcaccatgttggtcaggctagtctccaactcctgacctcgtgatccacccgcctcggcctcccaaagtgttgagattataggtgtgagccactgcactggccaatagtacttgttatctcactagcttaggttaatgacagctaatgaatcttatctttcctctgctagagaagtctgtgttatccagtcaatagctaatcaattgattaaaagagataagccagactttggcacgaagcatacatgccgttcattctagattattttctttaaaatttgttgctatcaacacttggggctcagaggtgtagactctgaaatgatagttactttccttttggacacttaatataatgtgcatttttctaggaccagaaagtaataatgaaggagtgatctgctacccttgaaagctatactgggattatcattcattcagtgcatatttattaactttgtactttgtacaaggcagtatgctagccctggaaacatcagtaaagccaaaccgacttaagtcctgtcctgatgaaggagaactagcaagaaatacagtaaatatagtaagtatatagtatgtaaaaggcgatccaaactggaggagggaaagggcaggataagggttggggagttgcagttttaaatggaggtatgtggggattgagttggcctgtggaaaagctgacattcaggcaggtccttgacttggagggaaaggcctgtgtggctatggaagggaagagcattccaggcagaggaatcctctctgtgtgccaggcatgccatgctgagtactgcaagggcgcagatggatgatacgtggtttctaccatcggggagttgacaggctagaaacaagattcaggcttgaagataaatgcagagaagcactatggcaaggtagaatttttctaagggtctctgttgaataatacaagctaagaaaatatgaaaaattattcctatttcaagaatgaagccaggttaagtgatagaccaaaggacctctaccaggaaagcttcttactcttggctctgagccaatttcctcctcagaagttgctgcctctccctgaggccccacgctgccatgagtccttctgactccctgtgagtcaccccactgccatgactccttcggagggggtgtctgacctcttgcttcaggcctcttctgggcctcacagtaacccttgtgaagctgaagatgggagctctcatcttccctaacccagagccaaccttggcctctctgcgtcatttgctgccagtgccctgtgtttgtttttgggaagagagggattttcaggcatcccgtccctcacccacctgacctaaccgtatggattcctgacaccacaggcagaggactattcttcaggttcctctgaagcccacctgttcagatgcttgcttcttttccttcttgcctgttctgactgtgatgacagagaccccgcctcaggaatctccacctcacactctattctcataagtaggtagaattttctcatcgcatatttatggttgaggaggagatagatgctgagaagttaaataatctaccccaaatcacacagctgtgagtgatggggcctctacttctgttgcaccaagctacctgtccatcaggggacttgcctcaccattgctttctgccagccctgggcttgccttaaaaaggacatcatatgcataagacactggttaaaaggtgcagcatggtccctggagatgctcactcttacaactggcctgtccttggggcagcagctcctcacaggcccctaagaggtagacctcctgcctgtggctgccagaaccctcttctccatcacaggtcttcctcctcaagagccttctctggtttcctgttgctttttatattaaatatttcccttagtttagcatcccgagtctgccttttgctgattgttccctccctgtgtctgcagacaacttcgttttcagccttggtgctctgtctcagctgcttctaccacacacataggatttaggcgcattcaggacctgtcccttcttttcaagggccttgccagtgcctacttgttgtcattgtctttgcagtactacggataaccttcctagataacccccctccaggaaactgtccccataaaccgggtgccctccgccatgattagtttgtatttgcgagtgtgttacttggttgtgttccctgaatatttatttggttttcccagctaagttgtaacttatttgaaggcacaaaccaaatctcataattctattaagtacctaaaaggagtaaattattgttaatgctccaattggctaatgtctatttcatattttacttaccagatttacaaatgcttaatattctgaaatatttcactctcatttacaaaaacatcagattctactaagcagaaaataaagtttaatgcccccagcacatagcagttttgagttgcacttttaaactcacttcttaatccatttcagggttttcaattgttcacagttaattcttcttaccaagggtgtattacacttgctcagcattgaatgatatggaaagaatggcctttctttcctgcataactgactttacttttgttcataggttgaaatcagcccttccatttcactgcagtattatattagtggcatttttatttagggaaaaaaaaaagctttcttccacttgaacttttgttacaaatcagtttattgggtccaatcaatgggcaagacctatgaaagggtgtggattatctggttggtcctttgtgtggcaaaaggcttagatgctgcttagtactcgctcattcttcatcatgtaaagaagtgttttttttgaaggatcaacacctgactgagccctgcctttttcatggaaatgttttcacctgagttgctgcttatggtactaagaattagttaactaatacttatttaaccttggaacaatgtttatcataatccgattggcagatagtcattttacttaggctttttctttatagcatcaggactagcaaatctcagtaaagagtatgctgggagcaatttcttttttcccaaataggttatcactctgtgctttttttttgctttccgtcaaggggcatgtttgggcactgtggacattaagactggtggccacacattaggaaggtggaggtcccctcttgggttgagcaccacttttgtttttaaagctgcatccccatttcatgctgctggcagtgtttcccttcagacgaatcccatgcaatgtatcactttaatatattcggagctgtttttcatgataaagcttccttatgagcactaccactaattaatacacaaaatggcccagcacaatttaataatttggtaatgtttttcaatgttttcttaaagatgacgctttacaagtcaagacccaaacttgcctgggtcatgacctctttgcagtttttggagtcttgttaaacaagaaggaaagcaaaacataaattagcgtctccagtatggttgctctacatttcccaatctttcaacactttgaagagcatagtcactgttaatgtaagagaacatctcatgaggaaactggcagcgattttaaaagtccggctttctggaatgagtaagaagcttcttcctcagtgccactgttctagggccaacattgtcctttgtgagagaggagcaagatgaggaagtttgcattatggactatggaacattaaaaagctaaaaaagagaagtaacagttacctttaatcatactgaggatgtatcagcatgtgtggcctttggcatctgttagcctttagggctatgttcccaagtttgccattagaatttagtgttaaaaaatactttaaatataacagcaccactttttgttatagtaaaaatgtatgtctttactcgattgtaattacctcaacacccagcttttgttgttattttgcccttggacttaggtatttctgttcctctggcttagaatgtccttccccttcatcttcctaatcaacctactcattccttacgactcaactcatgtatcatctcctccagaaaaagctttctctgccacgtgtttcttccctctacctgacatccttgtgcgtaatacctccacctttccatattgtactataattatctattttgcatctgtctttctgtggaaggtctgttgcatattcatctaggaacttggtaaatgtctgatgataagcatttgattttttcctagttgattcctcaaataataataatgattaccctttaatctgaatgctcacaggtgtacttctatctcatattctatgcgcagtcatctgttaagctaatggctaattgtaccagagggtctcaactttgtttctttgatctgcattggtttatggtggtaccttgcccattcttggcacagcaggtggataaaaacaatgagtaacattgagaaaggctaatgtgtcttattgacagtagtggtataatgtttaccaaacccaaattgaaattattttggtttcttaaaatcttttcccgatagcccatttattttaatgttctgaatttccaagatctgtgtataggttcaatgattagtctttactgaagacttatctatggactgagtgtgtattataaatctagtgacataagtttaaaacttattcctttttcattttccaagtaaacttttttagtaatgtgtttttctttgtaaagacaggcagtatatgatttaggtctggatctggtttccagtcttggctccatcatgtattggttatttggccttgaacacaaatgacttgccttgaacacaaatgacttatatctgtgagattcaatagcttcatcagtaaaatggggatagtagtagtactgaattttcatgattataatgaaaattaattgagagactgatctggagaggtgccatactacaaagaggattaagtggaggtgtccctattaaatggcgagatacccagaaacattaccctgttgactccagtatgctggcaacgaggctttatagtctttgggaaggagactggaagattcttctctgggaaaaatgtacacatactgacctttgaaggacccccagtaatcagccaggtcttacctgatcatcctatagtgaagccccccgacacagtatttccattcatagtttagctcttaaatgtgaattagctatccagcaatcaccagacacttgaggaaagcctccagaaaacaaattggaaaaaggggcaagtcataggaaacagacaaaacaaggaacagaagaaaacatcatttttgcaatctataatattcacaagtttgttttttgagacagagtctcactttgtcacccaggcaggagtgcagtggtgccatctcggctcactccagcctcaaactccttggctcaagcgatctgctcacctcaggctcccaggtacctgggacgacaggcatttgccaccacacccggctaattttggtatttttgttgagatgaggtttcgccatgttacctagacaagtctcaaactcctgggctcaagtgatctgtccatctcagcctcccaaagtgctgggattacaggtgtgagccaccggcctcagagatctaaaacaagatattgtattttaattgcacaggatgcaattaaaaaagaaaacattcagaaaacaagaagagctcttagaactgaaaaataagttagtgtaaaggttggaagataaaattgatactaacctgaaaagtattagaaagagaaagaaataaaaactaagagtaaataagaaaattagaagattagtcctagagaatcagtatccaactaagaggttcccagtgggtgatacagagaaaatgaatgggaggaaatctcaaggaaatgtatttcctagaactgaatgattggaatttccagtttagaaagaaggaatctagtgccagcaaaatgagtatagaaagaaccatcttaggatatgtagttttcaaattgcagaacataggaatgaagaaaagattctgaaagttttgtattaaaaaggttagaaacaaaagatcaaagatcagatagcatttgtcttttagccttcagtgccttcaaaattgtgagaaaaaaattatttctaacctttttatttatttatttatttttttgagatggagtttcgctcttgttgcccaggctggagtgcaatggcgtgatcttggctcggctcactgcaacttctgactcttgggttcaagcattctcctacctcaacctcccaagtagctgggattacaggcacgtgtcaccatgcccagctaattttgtatttttagtagagatggggtttcgccatgttggtcaggctggtctcaaactcctgaacctcaggtgatccacctgcctcggcctcccacagcactggaattataggcatgagccaccacacctggcctctaaccttattttttacaactagccaaactattaagacaaaggatacaatagtaaggctagaataaaggtatttccagacatgcaaggtctttaaaattttacctccctcactctttctgaggaagcttttgggtacatgcagcatagacaggggaatagatgaggaaaaggaaggctgggatacagggaatctaacagaagagagaggaaagctccagaactacagctgtgccccaggcctagagagtcaccgcttcagattgaactgtgaacacacaggactcctggaggggaatttcttcaagaacacaactttaaactatgtaatgtgtttgaacatactgaaaggagacttgtgattgttttagagacaaacttgtgataagtacctggtaaactaagcaaaggggaaaaaggcaattaactccagtaaaacaaaatgttgtccaagaaaggaaattgaatagtactctgcatggcctagctgtaaaccacatttgtataaacataataaatactgaatatagatttaactaaagactgtgaaataactgtatcggaaggatgtaaaaaggggcatgtggtgggggaaggggggtagtgcaaaattaataataaatccccatcttccatggtaggaagttagtaaatcatatttaaagctgaaaacaaaaatctaaaaccagtaatgtaacattattatttgaagataaggaagtaaatataagaagaaaagccaagagaattgaaaatggttgcctttgaagaaagggaactgagaatggtagcataagcctggcatagtttttaaactttttttaaaaaaatattttggggttaaaagtaaaaatgaaaaatattaaatgtgacaattatggaaagcactttagcccatgccttttacagttcagtgttgcataaatataaactcttattaccctgctccttctaaaaagtgtactaaagccttgtaaagccagcgccacatactttctattcatttcatcttttttccccaattcccaccatacatgtgccatgttggctctgaggaaggaattacatacatacacgtcagtatctttccatttgtttgtgtatcttcttgatttactaatccattgttttattgatgtgaatgagaaggagctgttcacatgttgccactttctgaatcatgtggttggtaccttttttcaggattttcaggaaaatcctgaattgttttcttctgttttgcctaatcatttgcatcggcaagattaaataaaagtcttttgcaaattgtgttcaagcttactgtagtttcctaattagtcttattatgtacattttaacacattttctccctatgatcagggccgcaagcttcttatcattgggaccactagccgcaaagatgtccttcaggagatggaaatgcttaacgctttcagcaccaccatccacgtgcccaacattgccacaggagagcagctgttggaagctttggaggtaaaaatgagtcaatggattgcacactgtttataagaaaggaattgaggctgaaataagtagtaccacattatacctggtgtttggtttttatgctaatctggaacatgggacccggggatattacaggttgtatataccttatccaaaatgcctgggactaggccaggcacggtggcttatgcctgtaatcccagcactttgggaggacggggcaggtggatcacttgaggtcaggagttcgagaccagcctggccaacatggtgaaaccctgtctctactaaaaatacaaaaattagctgggcatggtggtgggcacctgtagttccagctactcaggaggctgaagcaggagaatctcttgaacccaggaggcggaggttgcagtgagccaagattgtgccactgcactccagtctgggtgagggagcaaaactctaacaacaacaaaaaatgcctaggaccagaagtgtttcagatttcagattttttcagattttggaatattgcattatatttaggttgagcatctctaatctggaaatctgaaatgcttcagtgagcatttcctttgaatgtcatgttggcactcagaaagtttccaattttggagcattttagatttcagacttttggattagggatactcaacctgtacctccagttgttttcaggaattagagaagaaagatgaatatacatgacagtgagttaatttcccattcctcaatgtaggcagctacaaactgccaggaattaattgctctgtatccagcatgagtgatgtatatagattacttggaccagaaacttgaatgggtggtggtgtgggggtaaggtaatcactgtatagaaaaattaaccattcatagtggcttttagcacatttccttgcatttaataagttggaacaatgattaaagccttagaaatgtcaaaaaaaaaaaagctacagaagtaaaaggaactttattaacaagtttagaaatagaaatgttttcttaattttttgaaaatgacagtcatttttaaaaaagaacgttcttcatttaacttttaatatcaatattcacaagtaacttggtgagctctattggaaaatattatctactgagttgttcagcagtggtggagtcagtaaagcttcttaaagtcctcaaggcccccaacaaaattgaaatttatctatatgataaatgttttcaggttacccatgtagacagcttttgtgcagaagctgggtaagagaattaaaggagtttgctttgacacatacagattgttcctagaaaagaatgttaaaaattttaacttatatttattatggattggagctatttttttccccagaaaatataagttacatagcggtccataagaaaacagggtttaagataccagttttcactttcatgattgcacctaatgggtttaggatggtgaaggtcagactggattttaaagtaggagagaattctatcaacttgaacagttaggtagttcttatcactcttcttttaaaggtaaatagaattaaccaatgttgatgtgttcactgtaaaagtgctttgattattgtttattgtttttgtagcttttgggcaacttcaaggataaggaacgcaccacaattgcacagcaagtcaaagggaagaaggtctggataggaatcaagaagttactaatgctgatcgagatgtccctacaggtaaggtacttcgttctccgtatgactcagacagaacaaagcttcaggacacaccaagagggttcagtatttcctttgccaaggttttaattaatttaagttttgattttcttatattatttccaaacttaatttggtattagtagcctgcttctgagattgatcacttaacaatactttttaacttcttaaaattcaaaaatggaaggaaagattataaagttagttttcatttagggagccactaggtcttagaactagaaaagacttcaaagagcagtcgttcttctgccccctcattttggagatgaggatactatgtgagccacaggctgtcagtgaattatccaagatcacatcaccaggttattgatggagaagggatggtgttgcacctcaagtcagtaagcgactgcacatataccaaacggtgtctgggagactgctttaagggacaagttaattaagttgtgcagtctagacttgggatctgtatatttgtccctggctgggctcctagaaatttcatgcaaactactgtagggttgaagcatccagaatcacatagaaaactgagccccagggtgctgcctgggcaaagacagatgaaacttctttgggactttctcatatctcctggcaacttacctttcttcattttagaactccacccttccatgtgcccatgctgtgtcttcttgtccttatctgacatactaggtagctgataaatacctccctatcaagccctatgagttcagagaccttggctcttactattgagtccacagcccctggaacagagccaacacatatgaaggtgctcagtaaacttttattattattattattattttgagacagggtctcgctctgtctcccaggccggaatgcagtgccatgatcatggcttactgcagttttgacctcgcaggctcaggcgttcctcccgtctcagcctcccaagtagctgggactaccagcgtgtgctaccacactcaactaatttttgtattttttgtagaaacatggtttcactatgttgcccaggctggtcttgaactcccgagctcaagtaatccgtctgcctcagcctcccagagtgctgggattacaggcatgcaccactatgcctggccctcggtaactttttttctttttttttcttttgagacggagtctcgctctgttgcccaggcttgagtagtggcatgatctcggctcactgcagcttccacctcccgggttcaagggattctcctgcctcggcctcctgagtagctgggattacaggcgcccacccaccatgcctggctaattttttgtatttttagtagagatggggtttcaccatgttggccaagctggtctcgatctactgacctcaggtgatctgcccgcctcggcctcccaaaatgttgggattacaggtgtgagccactgcgcccggccagtaaacttctgttggatgaataactgtaaattcattttacagttaggtaaatggacagagtggctgtattctaggcatcatgtgttactaggtgttactaggtccatctaggtggacagagtggctgtattctaggcatcatgtgttacttactgatggtcctgcattctgctagtgtgggcagtgagcggcagaggtgaagtttctgtttcacagttacatctgaaataggctcttggaccaataacaaattggaaacgtgaagtgaatgctttttaatcttttctggtaaatttatctgaaaataaaatttttttgactttcagaaatctaatttaatctactgagctttcagatggactatttttaagtcaattaatttattttccattatgagccataaattaaagtcacagactaaccactttgtttagacttattcttggtaaaagtgcaaatacaggtgtattggctctttccttgaaaaaaagataaatctgtcagattgtcagcttctttttttttaagtttcagtataattttttttcaataattgcatagaagaaactatgtggattttttccccaaccctcatccctttcccttcctttgatgcctgcaggtcagtgatcaagttaatgcttcttatgcatgtgggatagagagtgagagtggggcactcaggcctgatcttcagcgactgacatttcataggcctctgagtttgaaccccttcatgtcaaatggatttcgtgcagctgagtgaattctctttagatctgccttagagaggctgaacctaagtgaagaggcatgtagttttgcagaatataagtcgtggtacctctctgttcactacatgctattctgttaaaacttgcacagagctgaggatctgctctgactggatgtcacctgagggaataaagtcatttatctagattacttttttcctccctttctcctgacttttaattccatagctacaggcaagtcagtaagttgttgctcacacatattaaatatatttaatgggcaaagaactgcaagtaccaactacaactgcgctccagccagttcttttttttttttttttttttaagaacttgacaattgattcatatgtaattctattcccaaaaaggaaaaatgtttcttttgttagctattcacactttttcttagtcctttgtagtctgacctcttacctttgatacatttgaaacttctgttcagtgtttttctgggatagaagaaatcttaaaaaaaaaagaaagaaaagaaaaaaaaatccgtggttggagtgggagtccaattgcacatctccccacagctgcactgagcatttgaaagttattcctggagggcagggagttccctcttgggaaacagactcctgctctgaaacatattttaaaagttaggtgtgtttcttacaataaaaattcatcttcaggaactaaagatgtttttaacgattgttttctagataacttcatatctcctgtgggcctacgagaataaagtacatttaacgagttagtataaatatgaatagaaaatgaaaaccagtcgagatagctaataataacgacctgaacgaagcacctgaaacaaagttgcgccatcttttcttagactcatgacacattcgcagtcacaggagacccagattcatctggagatgatttcaggaatcagcagtactcttcatttttttagttttagcacaactttgttactacaaagaagaaactatatgacggatactgaggctaagaaaagctacatggttggttatgtagagttaataagctattttttagttgttgaattaacctcaacttggtatcttctactttgctgtgactttagtagccttttacaccttcaacaggtgaattggttgtcatttgaactctgatgaatggccctgtccagtctcacagcgatgcctcacaggcatcagcacagggcacgcctggcccaagtgcctatgatggccagcgggcttgggtcttttggaacccagtgtacatagttctggaaaaccccattcacttcctccaaatgatgtgatctgctttgttttgtgtgagaatgctggtcaaggagcaggtaacacattcagtgacctagcagagcattgatgaagtgtgaaaccgaacactgccttctcatgaagcaagtgcagagttgttagaaggtaccattaacccatcttcatttcttctgatgtatttagatggatcctgaataccgtgtgagaaaattcttggccctcttaagagaagaaggagcgtaagtacatacaacatttaatgaccatcaaccaaacttaccaccctgttaaatccctgtgcctattctaagagttgctttcctagataagtttgtttccatttatttgaattcttcgctgtgttgtaggtccgagagaccaagcaaggaagttggttgtactgttggtttgctctccctgtcctgcttcgcaaaacttccttgtcacaatgcaggaaaaacttaatggtacatatttattggaacctgcttttacatgcatggagctgtgaccattttcttttgtgaagtgctcatctaatagcaaatgcatagtgggaaatgtaggataaccattaagaagcttttagtgattttttttttttttttttgatgaatagttttttacggaccctcatctgtttttttgtgttttggtatttcttttgcagtagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaa

SEQ ID NO: 992 - DNA, 7011 bp, Homo sapiens
ggtcggcgtgcaggatatttcgctggaccctagaaaagccaccacgacctgtgggccatgatgctaccccaatggctgctgctgctgttccttctcttcttctttctcttcctcctcaccaggggctcactttctccaacaaaatacaaccttttggtaagaaagctggagagtgcagtcacctccccctccactgtcctaaggcctgtactatttggggaggtgagcgggcatgggggctagtgtgggagaaggccagaagtgggggcagcagggagtgttgggtggaagatgtctcggaggaaagagagaacaacctggtcctggaagctgtgccagggcagtgccaggtgctgctgccacagaggtgaatgtgagagagcccccctgcccatgcgcacatgtggtaagggagacagatattcactcatgcaacacatttttattgagcacctactatatgtaaattatttttctacatttagtgatagggctgtgagcaagaaagataaaaatccttgcccttgtagagctgtcactctagtgtgtgaggcaaagaagtaaaacattacaatagatgctattaataatagcatctatctcaggtgataagcaaggaaagggaaaataagaatcgagctgtgggagtggtggtgtgagaagggtttgcaggtgttttttttttttttctttttctttttcttttttttgggacagagtcttgctttgtcacccaggctggagtgcagtggggcaatctcggctcactgcaaacttagcctcctgagttcaagcgattcccctgcctcagcctcccgagtagctgagattacaggcacccactgccacgcccagctaatttttttttctgtatttttagtagagacagggtttcaccgtattggtcaggctggtcttgaactcctgacctcaagcaatccacccgccttggcctcccaaagtgctaggattacaggcgtaagccaccgcacctggccagggtttgcagttttaaatggggtgctcagggaagagtttactaagaatgtgaaattttagcaaagacctaaagggagggaagtccttcctaaccggcaaagcaggggggtctctgggagaagagcattcaaggtggagggaacagccagggcaaaggtctgggggcggaaatgtgctggcatattcaaggaatagcaaagaggagtaagagagagtggaaatcatgggagatgagctcagagagataaatggaacacagttacaatattctcatttattcaacagttatgcattcagcacctgcaatgtgtaaggactttagtccaagggggctaagaaatatagcagtgaacgtgagagcagaagatccatgtcccagagctgaggttgctagcgggggaaataaattatttttaaacatataaataagatgatttcagagagtcataagtgttgtgaacaaagtacaaccaggtgatggggactgctctgctggtgtccaggaagtcttcagcctgaggcaggagggggaggcagccgggcaaagagtgcaggacagggtgctctgggcagagggccagcaagcgcaaatgccctggggccaggccaggtgtggattcagagccccagtgatggctttgaatccagagaatggcattgtgggaattatcttttaaaaaagactcctctagctattctgggaagaactgacttgaggaggttggggaggtggaagtgagagtggggatggtgagggggtacctgggggaggtcactggcaaggatggaagcagggaggccgggaggcggctatagccaatcctcctttcctgccttattttctttatagcacataatcgtacataataggattatacatatataatataaatattacttattgttatgtatataacatatgtggtaaaaatcacaccttactaggtgctcagatcttgagtttacatggaaatcaatggattcgaacctatgcagaccccctcatcactaccgtcagaacaagatataggacattttcattaccccaaaagcctcactcttactctcctagtcaatagcaccaaaggcaactgtctcctgacttccattattatagattagttttgaactttgtatgatgaaatcacacagtatgtacttttaaaaaaaaatttgggccaggcgcagtggctcacgcctgtaatcctaacactttggaaggccgaggcaagtggatcacctgacgtcaagagttcgagaacagcctgaccaacatggtgaaagcccatctctactaaaaatacaaaattagctgggtgtggtggcacatgcctataatcccagctacttgggaggctgaggcaggagaattgcttgaacccgggaggcagaggttgaactaagccaagaaagtgccattgcactccagcctgggcagtagagtgagactttgtctcaaaaaaaaaaaggggggctgggcgcggtggctcatgcctgtaatcccagcattttgggaggccgaggcaggcagatcacgaggtcaggagatcaagaccatcctggctaacacagtgaaaccctgtctctactaaaaatacaaaaaaaattagctgtgcgtggtggcgggtgcctgtaatcccagctactcaggaggctgaggcaggagaatggcgtgaacctgggaggcacagcttgcagtgagccgagatcgcaccactgcattccagcctgggcgacggcgagactctatctccaaaaaaaaaaaaaaaaaaaaatctgacttattttgctcaacgttttttctgtgataccgtatcatttcacttatgtatctcttccctgtcttccctctctagagctgtgtgtgtccaatagtgcagttactagtgtgaacccaaaatatctgagacaggtctcagtcaatttagaaagtttattttgccaaggttagggacacacctgtgatacagcctcaggtggctggggtgcaccttgctttttttttgttttttgttttttggggtatagcttgcttttatacacattggggagacataatatgtcagtcagtacctgtaagatttacattcgtttgatctggaagggtgggacaacttgaagtggggggcatgacttccattccaggtcataggtagatttaaacaaattctgattggcagttggttgaacagctattatcagcagaagggaatgtctgggttaagataaggggttgaggagagcaaggttttatcatgcagatgaagcctccagtaataggcttcatagaaaatagattgtacatgtttctgatcagacttaaggtctttgttaatgttaatgctggaggggtattaatgaggcatgtccaacccccacttcccgtcatggcctgaaccagtctttcaggttaaattttagagtgccctggccaaggaaggagtcgactgagatggctgtggattggtggtggtgggaggcttcaaattttatttttggtttacactagccacatatagttacttagatttacattgattaaaattcaacaaaatttaaaattcaagccaggtgtggtggttcatggctgtaatcccaacattttgggaggccaaggtgggaggattgtctgagcccagaggttcgagaccaacctgggcaacaaagcaagactcctgtctcttactggtggaaggtatctgagttattggcaatgaatctgtatgcatttacagcaacctcaattcttgcctcctcagaagaaagaattcaactgaggggcataaagcagaaaaagagactgaggcaggtttcagagcaggagtggaagtttattaaaaagctttagagcaggaaagaatggaaagtacacttggaagagtcccaagtgggcaacttgaagggcaagtgcagtgtttaaccttggtcctaccccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctaccca

SEQ ID NO: 993 - DNA, 56402 bp, Homo sapiens
tatagggaacattttatttggaaagattttgagcatcattctcttttcattttttattaaggcagtaacattctttcttcctggaggcggaggggggaaatcatctgaggctacagtaagttcaatctgaagtcaaaaccaaccaatttgtattcagaagcagcaaaaatactggttatgggctgggaggagccacatgttggctttctgagtccactgccaaggaacagatccagagcaatgcatttcaattgctttgaaaaatggctaagttccattacataccaccactaaagaagatacctcattgatggagcttttcaccatgatagagggcgtcttgcattggttcacaatggcctgttgctttttagccttcagttggtttagggggaaattgctcaacctatgagacctgctcaaattcatactgttctggttttgctttggaattctttgtccagtaaattagctcttcataacgcagttccaccatttcttatccagcatagattcattctgcccttgacagctggctaggtgtgtgtgtatgtgagtaggggtgctattgattggcacatattgtcccccctggagtttaggggtggcagaaagcttttatagtaccaaaaaagtaaacattgataatatggcctgacaacaatcagatatgctaagctctagaagcaaaagcaaggtaggattgcctccaaatgttgacaggtattagccataccacagtaactagatctaatgtgagggctaaatgcctggagaggcagaaccctaaaggatgcttagttatagctccatgctgccgccgagtggcttgatgctccattacaccctccttggatccaaccttccattaaggctgaaggctctagagggcagagtattcaagatgttagatctggtccaagcccaaattctagagttaaaagcagaggggttcttagtggctgaaaaaaaacaaaacctgatgacatttgggactccagttttgaggaaaggctctgatgatgaggcttacttctgcaggctaccagagactcctgagacttcaacagcttgactgatttatcacacactccaagtggcccagagacaaggacggccagaagagatgggcccccccggaaggcatggttccaaaagtgtgaggagcaaagtcaagggaggcagggtaggaagaggggacagaaagaggggcttgcaacagatcaaatgctgacctccaggaacagggtttagggcaggtgtgatgtttcccctcctggccctcatcttgaacaaagaaaagggaagccacatgaagctggtttgaaagattatatcaaaattaataccactgcagcttctatccttggctaatggcaaaagcgagaagggtacctggaaaataacttctttcttttcctctagattttcgaagaagcaaataaatcaagaatagaaacctatatataggaggttgggcctcctgcaaagaatgaagcactttttgttaaatacaggagaggctacttggctgcactaatatgtgctttttggaatcttatagagtgtcaccaagttgaactttggaatggcttgaatcatccctggagcatctgtgccgggcagtcaggagtgagtgcaccgcctcccacccagccccattgggcctcacaccctcttcattcctttccccatgaggcaggcaaacacggtcatgaccattttggggttcacttcaaccaggtcttctggcagggcatacactcttgctccaatttttcgggccatagagatggcatatctaaaagggagaaaagaggaaaaataaggagagcctgagaaacacaacacgaatgggaccctggagggtcacagtcacagtcgttccatagtcaggacagaactcactcctgcagtggctggagtcagtcaccagcatcctcacacttttgtggacaaattttggctcaaccaaagattctgacaaagcatcagacttgctggctagtctcgtgatcattatcaagtgtattatttgtccttggagacctcttcagctcctgccttttttttaagttaagtttttttttttttttttgtagagacaggggtctcactatgttgcccaggctgggcttgaactcctggcctcaagagaagctcttgcctcagcctcccaaagcactgggattacaggtgtgagccactacagcacgtgctgccacttttgatactcacaccaggagtattctcttgggctacatagcagcatagcagaaagagtcacagaactgaataaacatgtgtgctaggaaaagtttgcagactacatttcaactacagtaacattttgacaaggaacaaaagaggaaaaatgtataatatcctgaccttggccaggcgcggtggctcacgcctgtaatcccaacacttcgggtggccgaggcgggtggatcacaaggtcaggagatcgagaccatcctggccaacatggtgaaaccccatctctactaaaaatacaaaaaattagccaggcgtggtggcgtgcgcctgtagtcccagctactcaggaggctgaggcaggagaatcgcttgaacccgggaggcggaggctgcagtgagccaagatcgtgccactgtagtccagcctgggcaacaaagtgagactccgtctcagaaaaaaaaaaaatcctagccttacacatcaatttttttattctttgttccattccaattcttgcccacatatatttgtacttatttatggtactataatatagagtagccagagatttatattccatattttcacatagaatgataatagctgcatcagaacatttttgctctatttgtagatatatgaagataaatttcattaattgtaatttattttcaaatgagcccacactactacctggcagttcttttattcacctcgtttattatctagtgacctcttactatggttacaccagacactcttcactctacccaagcccacatttactacctcctgctctcctaaaattactttacttttactttattgatcaaattaaattaagagcatcaggcatgagtggtcccattttttctccttgtctctctctcaataacttcttccatattaattattaacaaagtaaaattaatttttccccattataaaacacagagggaaaacggtctgaaaattaaaagggagcttcaaacaaaatcacacacaatcttgccaccatgacataaccattcttcgcattttgtgtaatttctttcacccctttttctaagtaattttgtatctcgccctcacaggagagtgcttaggggtctgggctctgaagttggactttgaatctcagctgcacaactgaaaaactgtatggccttggcaagtttcttaaacctaatcacactccccttgaacatctgggctgaaggctttttacaatttctgggtcttcatatgtgtttttccttctgcctggaacattcttcctctctccttcacctgtctacttccttcttacttgtcttttcagttgagctcagctgagctgctatttgctctaaagagctctagtccccttcctatcccttcagggatgcctcatactgtcccttccacacctctcatcacaatctattgtaattttagtttaattatttatttctctccattaaattgtgttaaactttggcatcccgagagcacaggttcccactttcccaaactgggaacagagagaagggctctgttgggattataaagcagggatgccgggcactagatacttgtatcttctagacctgtggtatgagctgaattgtgtctcttcgaaattcatatgctgaagtcttaacccccagcacctcagagtatgaccctagttggaaagagggttgctgcagatgtaagtagttaagacgaggtcatgctggagttgggtgggaccttaatccagtaggactggtgtctttctaagaaaagaagtgtcgcagagaaacacaaagcgggaagacagccgtgtgaagtcacagacacgcaagaagaatgccatgtgaagatggaggcagagattggcatggggcagattctccctcagaagaaaccaatcctgccaacatcttgattgcaaacctctagctcctataactgtgagagaagaaacttctgctgcccagtttgtgcagtacttcgttgtggcagcccaaggaaactaacggaatctgatctgagaaaagcacctgtctggagcagatgttcattaactttttttgcaaaagactggatggtaaacatcttaggctttgttgcaactatgcaactctgctgttatagcagggaagcagctatagacaagatgcaaatgaataggctctgtttcaataaaactttgtttagaaaagcagacaacagggcagatctggctcagaaactgtaatatgctgatactcactctagaggaatcatttggcaggtgacctgaatggtaaaacacaagacagtggctttcacactggcaaaggctctgctgtggaaccctacccctgtgcattcttatccatgaatattcatgaatggagcatttggttaggaaattggttttatgaaactataggcttgcttatcaattacaagaatactctcattattgggttgtttttttttttttgtcttgctcccattctggcactagaagttttaaactactattgtcccatatccaaaacagtgatgatgagactgcagaaagtcatgagaaggaaaagcacggatagtgaaaatgaaatgtttgtataaaggcatgagcattagactttacaaccatccagctgccagttgggtccttccctcccaatctgaggtttatttttatttacgtactttgcattgttgagtttctcatcatcattcagattttctgtcttcagaaggtcatagttaatggaacctggttggatggcatcgatgaggtccagaacaggcagacttgtactaatcttcgggtcctatgcagagacacagggagggtttcatcaacgtgtcccaaagttactcccattcagctcaaaggaagtgggtggctttttcttcctaaatatataatatatacagcctggtctgggaaatgcagcagtattccacatagtgtttcaaataaactgtagtttctgtaggagcatcagtaacttcccagaaaacccaccgtctaccaacagcaggtagtcattctcaaataataaatggaaggaagttagcacaactagagaaagacgtaaagttaaaatagtggattgtgtcaagcatatgaaaaaatgcaaaaatgctcggcatcactaatcatcacagaaatgaggaccaaaaccacaatgagataccactgcacaccattcagaagggctattactaaaaagtcaaaaaataacagatgccagtgaggttgtggagaaaagggaatgattacacactgttggtgggaatgtaaattagttcagcccctgtggaaagcagtttggagttttctcaaagaactaaaaataaaattaccatttgaaccagcaatcccaatattgggtacatactcaaaggaaaataaattattcttccaaaaagacacctgcatgcttgtgttcatcgcagcactattcataatagcaaagatatggaatcaacctaggtgcccatcaacaatgaactagatagagaaaatgtggtacatatacaccatggaatactatgcagccacaaaagagaataaaatcatgttatttgcagcaacatggatgcagctggaggccattatcctaagtgaattaatacagtaacagaaaaccaaatactgcatctattcacttataagaggaagctaaacattgagtatgtatggacataaaggtaggaacaatagacattgataaatacaagcagggggagggtggaagtgggttaaaggtgaaaaaccacctgttcagcactatgctcactatttgggtgactggttcaatggaaacccaaacctcagcatcacacaatatacccttgtaacaaacctgcaaatgtactctctgaatcttttttttttttttttaaagagtgggttgtgttcatttttaaaagggcttcacataaaaggaatgtggggctagtatgacatttctttcagtacattatgtggcctcttttacttaatcaattctgcaacaacttactaagaagacaggagaaaatgagccccgagtgttacaaggagcaaaagaattgccaaacctttctaatagtgaaccccagcatcgcttgtcaaaccttgtccccataagaacaccccagaagccacagcctaatgtaatgggctggagcagcagctattttacggagagaagcacccctgggctatgtaactggccacttcatattaacagctaagtgacctatagatacactacactctacagcctcaccccacaggtaaaaggcattttcctcccatttgtggaccatcacatacaattactagccatactcttaggaagttacttgagctttgatgtcctcacctataaaatgaggaaaacagtaaagccagcttcacaatgtcagcgaagatgccctaagacatgaacaaggagcccctggtagccagagcccattcaatatctagagctcctttcaactttgcttttctttactgcctttccaaatctctttctggaagaatctgcttgccgcctttccaaatctctttctggaagaatctgcttgcatcagtgaccagcatccactcctaactctgctcagctctccagactgaacagtaggctggagatagagcagaggtgacggttatctgtgatgagctcacagcaggtggacactcctgcgacagccctgccctgacaatatcttctgctactgcttgtggaaagagattttcattttttcttgattttgaaacacaggatggatatcatgacgaaccacctcaccaaccctgttaatacaactcggaaggtgttcctccccctaatcctgaccttcaagctagaaaaatgtagttaagatggcacaggcattatgatgatgtggatcaagtgcacacgtcctttgaggaggaatccagttaatgcatgaaacatgagtcaagaaatttaataaaatgctgctattaataaaaatgagatttagatagaagtacacaactgcttttttacaaaaaacatcacaagggagatctttgagcattttacatgtcaccattataatattaatctgaatcatggaggtgcccacattttacgaatactatcatagtttatattactttgaaagaacaatgcctaaaatcttgcttttaaaatcatggattttaagtgggaactaagcactgagtacacatggacataaagatgggaataagccaggcatggtggctcacgcctataatcccaaagcactttgggaggctgaagcaggaggatctctggaggccaggaatttaagaccagcctgggccacatagtgagacctcatttccaaacaaacaaacaaaaattgctgggcatggtagtgtgcacctgtagtcccagctcctcaggaggctgaggcaggaggatcacttgagcccaggaggttgaggctgcagtgagccacaatcatgccactgtaccccagcctgggtgacagagtgagaccttgtcacaaaaaacagatatgaaaagtaaacataaataataaaaaatattaaaaaataaattaaaattaaaaatataaaaattaaaattaaaaatagacagtagaaactaggtgaatggggagggagggaggaggacaagggctagaaaactgcctgttgggtacgatgctccatacctcgctggtggatttatttgtaccccaaacctcagcatcactcaatatacccatgtaacaaatctgcacatgtaccccctaaatccaaaataaaagttgaaattttttttactgatgggtttttatgattaacttatgggagaaagtattgagaaattcattaatgaaatggctgatgaacatcaaaacaataacgagtcatttaagcaaaattgaaatgggagggggagcctctaatacctaccactgaaggtcacttgaacacataatgaaaacaatacagataggcatagagctcagatggcctctagcagaagacaaagaattttaccttgaaactagagatggatgaacttttctttgcttccctcaatgtttcattcacccagttgacaataatgtcatcattgaccttctggccaccaccaatttcttcgaggatattcagtgtatacctgaacaaaataaagaatgctttctggagaacagttgctaaagaatttaatataaacaaaaagtagctaaggatggaatttttttttcgggtatgtcatagaagacagtctggacaccattacatttgagagaaaaaaagaacatattacaacattagttccttttagaataacttaagacgtgactttatggctagtataatgaaatgtaaagcagatacctcctttctaagcatgatcattgctctgagcaaaaagaaaaagccaaagggaaaaaatgcaaggaaaggaaaatgaaggaaaagattccaacctgtggcaatttaaaaaagataaaaaatcaagcaataactcaatgttggaaaagtctgagtagcctacatgataaagaaaaagtataaaatactttttgccttatataagtaaaaatgttagaaatatgctgacaaagataatctttagtctgaaggtaagaattaccttagatacctactgttatgagaattggtttgtttgttgttttggaggggttgggggacatttattaagaagaggctttaacctcttaaaattctatagactaggccaggcgccagtaatcccggcactttaggaggccaaggtgagcagttcacttgagctcaggagttccagacctgcctgggaaacataacgaaacccggtctctaccaaaaacacacacaaaaaattagctggacatggcagcgcttgtctgtagtcccagctactagggaggctgaggtaggaggattgcttgagcctgggaggcagaggttgcagtgagctgagatagtgccactgcactccagcctgggcaacagagtgagactctgtctcaaaaaaaaaaaaaaagaaaaaaaaaaaacccacactgtctctggagcagagaagaaccaccattccctaaagctactcacttctgaaagggaaatgcatgggagaaagcccagcagtccaggaacacatgggtttgtggacttcatggttcaggttggcaggaggggatcaaattacacatgaaagaccttcagggctagaattacagtgtgtgcttctcaaactgaaactcaagaatcctgtgactgaatctcatctgaccggttctacctaaattcaggtcaccctccacttgtgtgctctaggattttgcttacataatccatcgggtatcttcctctagttcctgctcctatggacagtacagttctcccgtgactttccagatggttttcaagtttagtccctgaaataagagcaatgccctgcttcttctaggtgaaaacaccttcccattattgaagagaggaaggaaaatggcttgtgcaacttttctttatcaaaattcacatttaaactgacagtgatgtcctatcaattacacctcgtaagtctccctcaaatcaattagctcctcttcattctgtttctccacctcacagaatttcctttctgaagtacagttctggtctgtcttttttttttttttttttttaagagatggggtctcactacatggcccatggcccaggctggagtgcagtggatattcacaggtatggtcatggctcactgcgcccccgaactcctgggctcaagcaagcctccctagtacgggatggaccacagacacatgccacagctccctgcttggtcacatttaatgtgattcgacatggcccaaagaatacaggttaagctccagcacacagcacacaaggccctttacaatttggctctagtattcttttccagcacatctgtgatttccttcttccctctctgcttccttgcccatcgtgtgctacacacacacacacacacacacacacacacacacacacaaagacctatacacatttcaaccacacagaaccatcagcagctccccaggcacacctccatcctccttctgcctcctgcttctgggactcatctgtactcactacctgggcccccttcccttctagtgaattcctaatcatttgaacaatcctcagctcaagtatcacttttccagcttgcacagtgtattcatcagtattggtatacttgcttcaaacctgttcccagaacttgtgatggcattggtatccaccgtgtgccctcggacagggtccatgtgccctgttcatcagaggttagcagactgcctagcactactggacatctagtaaatgaaggcacagagaggcgggtgaaataaatagagtgactgtctcccagggaaagcaaggggataagaaagatgtttagtctggtccaagagatgggaccaaaatgctgagaaatcatgagtataaatggggtaagtgcagatagattttcaaaatatttctagtttggaaaagatcctacttttgatctcttcataaaggttacattttatggcataactggcttcttatttccagatagcatgcatattaagttattagcatttactgtaacatctaagaatttctgcctaatgaacatctgaattaaaaaaaaggtaggttagtgcttgcttcattaggtcctctctatatataacctgacggaacaaactaagtttaatcagtcttctggtagcttctcttgtcctgagacctagttctcacttcccttcatcaggagttgcagcccggcgttgtccacatgctcatgtaaacggcagcagtgttcttgacccacctcctaagcctgggaactaaatggtgcagaggggaagcccacctttatactaaagtttgtctgcaagagtgagaagctactaaggaacagggaaccttatagaggtatagcaaattgtggaggcagcttattccatgctggggtttgagaacagcctctcatagtggcacagagttccagtgaacacaaggcagtctttctgtcacctcaactgagatgcagaggtttgaaatggaatcagacacccacttgtaagtaaaacgataaaaaaaaaaaaaaacacaaagagaagaaagaatagaattaggctgggccgggcacggtggctcatgcctgtaattcgagcactttgggaggccgaggcgggcggatcacctgaggtcaggagtttgagaccagccttaccaacatggagaaaccctgtctctactaaaagtagaaaattagccgggtgtggtggcacaagcctgtaatcccagctatttggtgggaggctgaggcaggagaattgcttgaacctggcgggtggaggttgtggtgagctgagatcgcaccattgcactccagcctgggcaacaagagcaaaactctgtctcaaaaaaaaattaggctagagcctccattctagatagtacactaagcaattgctcatctaaatacagatttgaaatgtaaaacaaaaactaatttggcctgtgtctttctagatttttccttttgagataattactgcatattatcaaacctgctttgggacgattgtgctattaaatggagccctccagacaagatctcagtattaccagtgtttgtaaaatgtgctgtgctgaaaagctctttgtcaaaatgaaacagaattatgagctccagctttagccagttcctccttcaacaagagagttgatgaggtttggatgtgaggcactagagggatgtgattagtacctgcttactttcctgccttccaacacttgttttacttatttattatttggcatagaggaacaaaccaggcattttgtttttcaaggacccatcctgacttcaccatccacagcctgtttgacctggggagagtttcctaattgtctgcttcggattctttgttcatttgcttcagagccatcattgccatgtgctggcagcctgcttgcttcaagggttttatctgcaagtttatgcatatgctgtttgccaactgtccaccctgagaatgatttccaagctactgaaggggatagggaagtttaagtacatatctctcatttgctctcataggaaaaaatgacaagccatttattgtccagataaatgaccaaattagcacatcagcacaattcaatgaaataaattccagctagaaccagctgtaaatttaatagatcttttaatatatagcatgcagggaaaaaaatcccttccggtgccatttatataattatcagtcattacttctccttctacagtaatatatttttctgtctactttcttaaatgcacgattcttatgtagtaaacactcatgagaaatatgactttttaaccaggtggagacagcaacagcagagtggaccttgttgtgtatgtgccagccattaaatagggctttgagccacatttttataaaacatccaaagatcatattgcaagacgtttttcagatattatgaaatttaacatagaatggggttgacctgagtttgtttgtttgtttttttctgagacagagtctcgctccgtcacccaggctggagtgcagtggcatgatcttggctcactgcaacctctgcctcccaggttcaagagattcttctgcctcagcctcctgagtacctgggactacaggcacgcaccagcatacctggctaatttttgtatttttagtagagatggggtttcaccatgctggccaggctggtctcaaactcccgacctcaggtgatccacccgcctcggcctcccaaagtactgggattacagtatgagccaccgcacccgctggcttgagctttttaatcattaaaatagcatatattaaagattatttaatattgaaacccatgagtcagtttaactgttgcaactaaaaggacttttgctttggtttttaaagcaatcagtatgaattgctaatctgttaaaaatttaaaacttgtggaagataataaagatagcttggaaatatcatctggaaatacactggtgagaacagccctgaggagttttcaatgatgttctggatacatgcagtaaactaaaagacagagttggagtttctttagttctggagttttctgcaccaggggagccttatgacatctgcccccatcattaaagagaccccagtgtggaaatgggtaatggagctctatacttagtaaagcaaatgtgaatcagggagtgaaatcttttatgatcacttctgattatcctaccttatctggaaatactgacacgattacatccagagccggccattattaggatctgcagacagtggcttggaactaaagctgcagtgcctaggcacaccacgaaccttgtctttgccattatctttccagacagaatgtaatgtgacatgcagtttctggggcttccttccaggtaggaaaatgaattgagtcacactaacataggatctaatgaggggatgtaagattcttgccttgtcagagctattagtatagggggaaagactgaagcatttacaagtaaattattttattacttacagaattcctatctaaaagtcttcccaagcttatgattttgtaccaaaattgtttctttttcttataatttattttctatttgtgtatctttttataacctatttttgtttaactaatatcaccctatacttctcacattagtcaagtttatattcagttccaaaacatatctaaagttttgtatgaaaggaacttctgtttctggccatgatggaataacagggcccacatttaaacacttataatacagtgaaaaacatatgaaacaatgttgttcagacatcagacaataggaagcacaggacagtggcccctgaaaagaagaaaacaaagttagccttaagatttttccagcatggaaaaagtttccaagctgcagcataggaggagaaaacccaaacagctggccatcctcttgagtggaggaaacagggatgagaaatgaaggaagcccaggtgcctagaatttaggggaaagactatcagagtggtgagaactgtatagagagaagagagtcattcagaaagaaagcttcagcggccttcagagggtttccctcagtcttcagctgaggaccactcagtgcacatgtgtgaggaaactactagaggctgtggggaaaaacccaccagaaatgagccacgagagcaatccttggggctcacacaaggctggaaaaatttgttcccaccagctggagtggaaaaatttcataatacatgagcatcaagcaaagtactcagaagaccattttctcattactaacaagcaaaatgagctctagattaattaagcttaaaagtaagcctcaaatggatcaaactgtatttaagttacttaagtctatcccaggattaaatttaagaatatttaaaggaatacagaaatatccagtacacagcaaggtcaaattcatgatatttgacatataattaaaaaattagcagcatgcaaagaagccaaaaaatatgactcataatgaagataaaaataaattagtagaaacagatcccaaaataagttactgtaattattttctgtatgttcaagaaggtaaaggaaaggacagctatgggaaatataaaaatgactcaaaatttctatacatggaaactataatgtccaggttaaaaaacatgtacactggatggagttaatggaatattagacatgcaaaataaaagagattagtgaacttgaaaacacagcaatacaagttatacaaaatgaaacatagagaaaataaatcactaaagcatcggtgagcttagggacaactttgaacgatcaaatatacatggacttggaatcccccagaaccagggctggtgggtatggaagatatgtttgaagagatgaaagttaagttttccaaatttgatggaaagtataaacccatagattctataagttcaacaaacctcaagcataagaaacaacaatggagctgggcatggtggctcatgcctgtaatcccagcagtttgggaggctgaggcactcggatcattaggtcaggagtttgagaccagcctgtccaacacggtgaaaccccgtctctactaaaaatacaaaaattagctgggcatggtggcgtggacctgtagtcccagctactcaggaggctgaggcaggagaatcacttggacccaggaggtggagattgcagtgagccaagatcacactactgcactccagtctgggcgacagagcaagactctgtctcaaaaaaaaaaaaaaaaaaaaagaaacaacaatgtacatcataataaaattacctaaaacctgtaataaagagaaatcttaaaataagccagaaaagaaatactacatatgagggaacaacaataagaatgacaatagatttccccttggaaacaatgtgggccagaagacagtgaaactatctttaaagtacggaaagaaaaaactatcaacttagaattctgcactcagagaaaaaaatattttgaaaatgaaatagacattttcagacatatagaagctgaaatcactcatcaccagcaaacttgtgctattagaaatattttaggtagacagaaaatgataccaaatggaaatcttgatctataaaatagtaggaagagcactagaaatagtaaatgtgtagataaatatagcataatttcccctttatttaaaaagtccctttaaaagtaattgttatttacacagatcaattgaagtaaaaggatggtaaaaagataggccatgctaaccactaatcaataggaagcctatagaagcaatagtagctattatctattaatgtcagaaaaaatagatttcagagaaaagaatattagtaggcataaaaaagactactttataaggacaaagggatgagtaaattagaatgaaacaacaatctaaactgtttatgaacctaataacagagtttcacgatacttgaaacaaaaactgataggactgaaaaaaaaaaagcagaaaggtaaaaagtgtttctctggttatgaagcttagcttaaaacatacttttactgaattaactcatactgctaaaaatttgctaatatttgtctaagtaaataatgtattcaagaaaaagccacttccataagctatactaccttctcattagctgccaaatcaaggccagtgtgagagtgcggtttccttcattgagatcttgtccaccgatgccaaccagggagaacttcgcttgattcttccccaattctaccgcgtagttacaattctcaagctgaatgagcagaaaggaaaacgatttaacgtcatcatcttgattatgataaataccagataaataataaaaataaagataaaaaatgaaataaatatggtaagaccgaatgacctctcaagtctcaactggttctgcaattctaggattcaaaattaaagaattttccatctgtccttagaacccctcactttcataaaaaatattcataatgtggaaaactgaaatgaattcattactatgaatatgttcacagctatatcacactgcagaaatggagagccatccttaattacctacatgtaatatttctaaaaaaggtgaattcatggagattgacatggaaaatttggagtctccatcctctgcacacatagcaaatggacatgtgaacagatattcctgtagctacgcatggatcattaacagtcacggcaataagaaatgctgagaaatggctgtgtcaaccctgttgtttcaaaacaatgttcccactgtgttgacagtcgacaaactgtttgaacaagtcaagctgtcagtacaagctccaattctttagaaattagaataaagatcctgctgagggaaaaatccctgtggctctctgcttgctctaattatcttaattagaatttttgcatgataatgtttgaagacatccaacatggaattataaataagcaattgactgaaataatggacacactttaataaagctgttcaggtttctgattgctgtactagaatttaatttctggaaaaacattacttgtctacgtttggctgccttataaagtatttagagtgctcttgcaggctatgactttgcctgtctcctggaacaacagaaccatcattgtttaccttcttcatattgcctcccagtttggggtatggcggtttgtttactctgttccagtcaacaggaactttgatcttttcatagagctggaagatgaccagggcatctgataagtcactgaacaaaacaaacacaaaaggattctcagatatccaacatttattcagggcctacaatgggccagacactttcttacatattagttcaaagaatattcacaacaaccctgcacacttggtagtcgtagctccatctatagaggtgaagaaaccatgactcagagagattgggggactcactcttcccaggtgtgactagctatgcccttccatccaacatatgctgcctcaggaaaagaaagagcactatggtgacgaaataatctgtacaccaaacccctgcaacatgcaattaacctatataacaaacctgcacatgtcccctgtacctaaaggtttacaatttgtaaaactaaataaatgtaaaagaaatatttagaacgggcgcagtggctcacgcctgtaatcccagcactttgggagaccaaggcgggtggatcatgaggtcaagagatcaagaccatcctggccaacaaggtggaaccccgtctctactaaaaatacaaaaaattagccaggcatggtggcaggtgcctgaagtccaaactacttgggaggctgaggcaggagaatggcgtgaacccgggaggcagagcttgcagtgagccgagattgcgccaccgcactccagcctgggcgacagagcgagactccatctcaaaaaaaaagaaatattgaaaaaaaaaagaagaaaattgctttaacaagtggcataggagacacttcaccacaaacttaacatctgttgttttgcctgcttgtgagcgggttatatgtaagatcacttatgacatatagtaaatgtttcattttgttgaggtatgatttatatattgagcacacagtgagactgatgtatgcaggtgagtttttcaactgaatatccaacatctgaagctcaacttggcactttttccccttccagcaaggtatgcacattttgtgaagagaatgcacatcatagtggtatttggaatcctatggctcttttgaggtctctatcttacattagaatgagttcccaaatattcctacctgtacaaatgattgactcgagggttaacacccagggagttcatccagttcctaaatgtccgctcttctctcgtctcacctagatgaatgaagatgggttatcttttgggaccgaagaaaacatagcttttttatgaccaaagtttaactaaagaggatgcaataaaaactgaaagtagaatgaaagaaagaaataaaataaactgtattggatttggacgagggttcttatactgtgttaatttttcttttccatttcaattccgcatgtatttctatagtatctattaatagtgtgtggaatcctgtgtggggtagctgttcagttggctctcaaaggcttaccttcttgctggaaaaaacaggacttttaggcatcaaacagagatcatacaagctacagaactcacttatgaggtagatatatttgttatttgaattgagacagggaaaagaacagtatggactgaacttggaaggggtggaatttgaacttgtccttggatagctagcaaaatctggatcagaaaaaggaaagagtagaggatttggggagatagcaaggggtgggagtagaaggtagtataaatatgcatacaaagggagcaacaggcaaggtctctattaagaacatcaggaactggtttggtcaggggtgtgtgttgtacagcccaatgagataagcctatctggaagaaggattcagaattggggatctttggataccaggtagcagattttagttgacagacaacggcagtcattatggctttgtaaaattactacaataaattcttgagcaaggcagagatataataaaatcagtaccgggatgtgactggcagcagtgtgcagaatcactgaaaggcgatatgcatttgaattaaacacggcagaggacagagtgtttgacattagcatgtgggatacattcaagcatttgataaatggagactccaagatccattaaaataattagtgtatgaggtaatgagcttggaatagcataaaagaaacataacaattgagaaaatgttccaaaggaagaattattagtatttgctgatttagtggatgtagggatgaaggataggaagatatagtaggatccaagctctttagtttggtgactaaagaaaaaaaaatggtatgattaatggaaatggagcatttctaaaagagggcaggccgggcgcggtggctcacgcctgtaatcccagcactttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaaaaaaaaaagagggcaaacgggatgggaggtgggctggaaaggcaatggttgggggtgggagggaaaataatcaattctgttttgcatatgctgcacctcaaatgatagccaaggatccaaacaggaatattctagaagcagctgaaatgggtgatttgtgggcttgatatatagatttgggagtcaacaaaatacacacaaccccctgaccataattcagcaaatgacaccaatgcaggagtgttggagcacgattatgctgcatttctagtgagagtaaagcactgtggaaaaggatcaactcatacttcaaatctgaatctccttgcttgggtgatattcatttaatattagttgacctttgtctcaatattgggactagttcatgatttttttaaaaaagtcaagtaaacatctccagcacctctacctggtagaacgtaattaaagctatatgctttttgttgaatcttagagcattaacctgaaaaatacaactgttagggattctgcctcaaaatacttttctgtggctcccgtaagaaacaaaagaaaaccaaaaactcagtaagcatatcccagcataccttaaatatcattttttggaaatggatggtggcaatttcttgtctctaggaatcaacacagtccattaagtacgtaaattatctttttgaaactcaggatttatttcatctaataactaaatgcattatctttcctaaaacatttaattctgataatggatgaacgctttgttaatggacgtgatagaatggtatttgattattcctgcttggctgaaattgacttgatgaatctatttattctctttgttgcataccagagaattaatggcctgtttgcacatgtaaatagtttatatttgcttaggaagtgagtttgaattgccattgaattagaattgtgagtgcctttccccatcttaggcaaatcgtttacagttaccttcaagagccccccagtcaatgtcctggttctctggtttgtgcagggcagggtatctgttaaagaggttggcaataaaagccaagttcaacttggggttccctcggacaacatctgtggctgtgacaaactgccggcagcccagcctctccgcctgctgcagcatgcattctgccctctggatgtcatccttctcctgcaatgcaaaaggatgtctcagggctgggtcaaggctctccatgcacaaagcagattgcataatgtgaaaagaaatgggaatctcactgaaatcattagtgtttatctcaggcagacacttaataacagcacattattgcctatatgcacctgcaccaaaatcagaaagtcacaagtaaaaggaatctcagaggttaagtaacaaggatctctcatctcctttatcaaactatttcagatgagtggttggttgctctgtttcaaaagagatgcagtagattctgaaaactgatcatttgagtttatcttaattatttccaaccattaagattcctttttattatttgtgtgcacagatgacatgagattgtctatcaaaaattttatttattaatttatattcccataaccagttcacaaaagatatttacacttgccagtaagaacatatgattagcataaccactgtctccacattgagttggtatacttgcaacccaaataaaataaattttatcagttaacctatgtattattattgataaatatataatatcaattttatttttgcagacttcagattttgaaccactcaatgtgctcaaataattctagagaatctctagccatttgtaagtgactcttaaccctaaaattttgctgaaatatggcccactgtccttaaagtacatgaaaccaccaattttcagaaaacaaaactttaaattaggatgatttcttaatatgaccctttactagataacgctacacattatgcatttcatgagctttacttgtcatttacttttactctacttctcattaggaatcagttgacttcaacatgaactcattggatttaactccagtgatattaaatgaggcacagaaacgggcaaagagacttctcaagatcagtattaaagtggcggcaaaacagaagttttattataacattcagacccatgtggggttatagagtctactaaatgatgaacatatatagaattgcctagcatgctggatggtgtttaattactattggtttctttctttaatgttgtatttccagattcagttttcatcaattattatcccaaactgctcacagttttaccgttttaacagggctttaggcagaaatgcccagtcatggaactccagaatcagggccacacaaggtaatggaactgccaacatgaaaatagcatcatattctccaaacacaactgggacctggccttacccgcagtcctgacatgtcaataacaacagcaggaacaccttcttcatctccttttggagccacctgctcaagcaggtggtaataagcttttgagtcctgtgagaaattaagaaattccaatttcaaaatagcacagctaattacatacttagcataacaatgatttcccaaaagcaaacattttatttcatattcagctatcattccagaatgtaacttaacaaagctagaaacattcactaatttgaatgttctatttgtctctttacatatcacatttgcttttctttttaaaaggagcgtaacaataaaatagacaagatatacacaaaaggcaccctaaagaagtggatattattctgttgtctttaggggagaaaaacaacttatttacatgaattaaattgtatacaggaaaatatatatatacctttatattgctgtagaagtcagtcagctaaggtttaattaaaaaaaagtgacagaaaaaggaagcacaagtttaaagcgagtttaaaatacatttaaatggacaatcagcaagagaaaaagatgtcaaagacagaagattgaagcattaacaagcaatctttacgtaaaaggagaaatattaagaaaagtgcatttcatatttatctagaagctagaaaaatggttcaatttagttatagcagattagatacaggtattgaattctcaagttttcttagattctgaaaatatgcttattgacaaaaagaattctcagaattatagtcttaaaatataaatttattcttagtcaatgaaagcatacagattttcaggtagtttatttaaatcatttaatagcatctcaatttctcataaagatcgaaaaatcagctattattttgtttctacaactggttagggtaggtaaggcctgggcagaggagaggtatgctcaccacttttggcattagaaagaggagaaccagagagtgtgaatcattgatgttgcacctggggaaaatgatcttcatctcccttctatctaccctcccttctctgacttttcactgtagctattttgaagtcagtgaaagtcacatgcaggtgtcaggcaccaataccatctgcctgccctgggttacatctttttagtttggctaagagtaacctcatttcacctgactctcatgaaccttctcactcactctagcctgggtgttctcctcgcctttgccaatttacacgatttaaagacatctcccaaggttgctggctggctactcagacatacacatgacagcacggagtcagttgccatgcagcggctgccagagaacaggcacaacactgtataagtaagtgctcatctggccagctcctatctcatacagacacttcccaaagcacaaaatggtggttctagagaacacagccatttaatgacaggaaattaggtaaatttacagctgagatctgacagcctaattttgtctgaaaagttttgcaattgcagagcttaactgttgagcacaaagggagagcatgacagccagctcctgttaaaacccaggtcggttggtggtgctagaagaatgttaatagcccatgaaagatgcatagttagaaagatggatttagcttagatcctaaaaaatgggggctttccatctagaagcttgactctgactggcacagtgcctgacacacgctgagttctaaatgccactgaatgcacgtcatatagcagtgggaaactgttactcaaagaattacaagcctaggtgtactcctgttgagtcatgtgaactttcctctgactctttctctttggggaaaagttatttaatgtttgagaaagtggagactgaagtattttcctggtgttgcatcccagcatctcctactctttccttctagggaccgctttccattcctttctgctccttaaccactttctatcttcatccatctgtcatcattgccaatagctgttttctttcaccttgacagggaacttttcatatacttgaaaaccacagtgtattcctgcctcagcctttcccctatggacctctttgtctctttatctgtaaaatgagaggataataacccttacctcatggggttgttgtaaggattcaataagagaatacacatataaatcagttagaacagtgcctggcatgttgcagacaccatgtttgctgttattagtataactagaagagtcatcttcatttaattttttacagggaattcccatctgctgctcccatttatgaaaccagagacattacagacctacatatattccctttacttggacagcagactgttctcttgctcttcctctagctcacctttgtccctctacttcctgatatggaaactccaatcgagacactgcactaggactctgggcaggtctgtgtatggcccaggactagagcagcagatgggctctcaaggacagtgagcacctccaaaacagcaccagactaccctggaacttctgaagagaggaagccccaaatctttatcttttctttattattgcccaaattccccttcactcctgcagagagtcatgttcaaacaacgctcctcctaccttgatgtcagtactgaagttgccaattttgttgcagcctgcattttccaggtggtaattagcccacctcagcaagagctcttcaggggagagtttcatcaaatcctccaggctctcaccttctctcaaaagagcaatcagagctgaagaagcacaaaaaccacagaaaaataaatgcagcgatgttgggggaggggggttggttataactttcattaagctctgctaaaaagctaaagataacaacgttacctctttggggtaaaggttcttgtagcctttcccatggattaaatattttattattattccctaaaaagaggcgtaagccattgtgagcttatttattatctccattttccagatggagaaaacaaagcacagtgaatctcaacgctatgtttaagaacatttgggcagagccataaaaataaccaaggctactggctcggatgttttgctgggtctgtcaaaccacatttcacaatatgacaacatttttgcttttaagagatcaattttgtaataataacaatgttctcttgtctattcccataggtgttttatatttcaagtgcttacctgcctaattatagcaactcaacaatgtaatcaactctcctctacgttttcccagatgagtaagtatttttttgctcagctagaaggtttaaatttagctgaggtcattatttgaagatcaatattctttctcacaggttctaagatccctatttcctctcccccgccttctttatattatgtttaatacattggtttttaaataatatttcaggatttttcattggttattgtgatttggacatataaataaaaaagtatgtataactaaagattagaacttgactacagatttcatattggtaggatttgtacctgataactaaaagataacatcgtgttttgcatgatacttatcaaggtgggctacctctgtctaagccagggggctgtcactgtttacatacagataagatggtgagagaagacgcaataagattgacagctacatatttagttgagaactctgaaaccctaaatggaattttctacggtctttaaaaatgtttattctagcctgcatagatttaaggtgtgtaacgtgatgttttggtatacttatcttggtagacacatacacagtaaggtggttactgttggtcaagcaaattaacatactcacatctcatatcgttacctttctttttctttctttctttcttcatttctctctctatctctttctttctttcttttttgtaggaagagtgcctgaaatctactttcttggcaaattaccagtatacagcacaatattattaactatagccctcgtgctgtttagatctccacttattcatcccatataattgcaaccttgaaccctttgacctataccttcctctatagttttgataagaaatagaccaagttcctcctaatctggtaccttcactatagtatatgaatgtgagttgcttacttcgcaaagtgcaagttaaaagtcctcttatttgttacaaatatctaaaggcaaagtgagctctgaaaaaacctcttgaggttagagtgccaaacattcaagactgagccctatgctccaaacaaacattattgttagtctatggtcttaaaaagcttttgctctatcattaaaaaacgtctggtctgtgtgtatagaatctgtgacatgaataccatggaatcaatataactgtgtagttttcaaaacttgagaatttctgacatcttcctcctacagtccccaacgcgtaagttattagaaagctgtgtcataaatgacctttgggacttgctcttaccttcatttctgctgagttcaatgtcagcaaacaacccaatcttgatgacttgccacagaagtcccaggaccagataaggcttcccctccttcaggtcctcagcccctatgttgaccacatggcacccgatggctgaggcagagttcagagccaagttcagattttcctgagggagaaaatgtatgcaagtttttgttctatgactttgtagatgccaaataataccgatggcaacagtaacaatgttttccttctgcgaaggtcacaggtttagagtcatggtcttcactcattttaacattgagaaaaaaacagtgactcataaccagaagagaaaatccagtaacccagacaccgaccactcatgcagtggtccattcaatcaaaccagcaccataagttgaaggcccattctggttggcatgagactgatgaggcctatatttttccatcttgctctgtgatgaagctgacacacaaaacatctctattggccaaaaataaagggacacctttgagaaagtcattgtcctgtcactggccatcatgaataagacaattgttgatgtaaatcaagatcataaaagagagtagcagaagagctttttgacttgaagattgggtgttaagaaaatgaaaaggctggcacggtggctcatgcccataatcccggcactttgagaggtcaaggcgggtggatcacctaaggtcaggagtttgagaccagcctgaccaacatggtgaaaccccatctctactaaaaatacaaaaattagctgggcatggtggcaggtgcctgtaatcccagccactcgggaggctgaggcaggagaatctcttgaacccaggaggcagaggttgcggtgagctgagatcatgccatcacactccagcctgggcgacaagagtgaaactccatctcaaaaaaaaaaaaaaagaaaacgaaaatgaaaaatagatacgattaaaattcctggaaaagatggaatggtttttgctaggttgatttgttgagtatctgtaataactagggaacctgagtatacacacacatactcatagattctatgttcttatgagtaacaacaatgcaggtaatgtaactcacatatagtcgagatagagtcaagggagttttcagtccagactctgtatgtactattcttgagtttaaaaaggaagagatatcaatgtcagagatgtatagaaattgttttaattggcaaattaaaaacaaagcaaaggccgccagtgaattaggaaaagaactatcagaagaaaagtgggtccttgttctagtgcttaaatgatgagtgaaaaatactgtttctatatatggtcaagattatgagtaaatttaacattaagtgcattcatatgtgtttaatcattgttctcaatttggttaccatttccatttttaaagtacacaaggttgcttaaatccacacaggagataatgtatcgttcatgatttaagaagttagatatggtttcttagcaaaagaattatgataatgttaaaatattggaacacaacacagaaatacacttactgctggttactattccagttaatcaacaaattgatggaataaaagcaagttatatttattatactcgtggctgtggccaaaattactatgaaggctgccagagtacttcccgtttttcaccccctcgcttcttagaaaggcttatgttttcatctaaaatgctgtttatttggcatcaaatcaaagataaattgctaaggaaagcttgagttaaaactttagccaaagtgaattttattcctaagtggccaaaacaaacatacaaagccccagctgctaccactccaccagtctcccttctttgctgctcagaaatgtatccctttatccctgaagtatgacaagtcaccagcccaaagcctgggttttgcgaatgatgtctgagcccctgaaaaaggcggactcagcagttatgatgctcattgatgccaaacaaatcctgtattatggtaacggtgggaagacatacctgaatggtgaaaggggttagcttctttttgttgattgttctttcatcaattgtgtctggcactgacaggttgatcattttactgaaagagaaacaattaaattaaagaaagcagtcttctgaataacagagcccagtaacgttgaatttaaattctagcaataccataatcaaagaagatagcaacagaatctgtgatgtttagatataaaatcagttatgccgtttgactagactcaaactatctgcgggaaaggtgaatactactgaagccacattcatatattgaggttggaaatgaggaccccacttcattctcccacctaaacagctgcaaaattatcctgattttcttagcacattaggaaattctgggtggataaccaaagtaattctaccataagtactttattttcttagccatgaaaattgtccccattatataaaagactgtctacaaaattctgagcttattattgtctacatttctatttgacacaggaccaaactttgtatcttcagctaatcatatgataacatttttatatccttctcagtgccctaggctgagtaccaatgagtcacaggggtcttagaaggtaaaactagcagattgggggaagaccatggggtgccttgggtggcaacctaaaagctagaattttgatttttttatagcaattgaaccttttaaaaatgaattctcaggacaaactaataaataaaatatcaaaagtagaattgctctggtcagagcagaggagaaagctcaatgtctttcccacccattgttatcctttaagtcctgagtccctcacatattgagcacctcaagtcacttcacttacaacttggcctgtgatgacagagaacctgctgaagcaagagctacagaggtattttcaaagacaccacgttgcattgagcagcaccatatttagaggcctcccgtgggtaggatgcagtcccccttttccaggtgtcctcaatgtttgagttgtggatttctgtgcatcactcaaaggtttctttgcttaaggactacagtttaaggacttcttccatcatcctgctgctattatcaattctatctgctttcatggtgagccacgctcagatgaagccaagcagcatatattccaaaaatatataaccaggaaaattgtcctcattatagaagagactatctatgtacttctgagcttacataatgtctacatttccgcttgatgcctgatccaactttatactttaaacttgtcatcagataaactttttaatgtccttctatagtcattatttaatcagtattttataagtttcccccacttaattatctaatacattgattagacatctaatgcttttgacttggtataactatatcttccatgtttatctctataatgtttatccctcctctccactcaagcaatagcaattttacatttctcattataaattgtttttgaatttagtttgctgtcctggacctggccaagtgaaagtccagaaaagccttctaggtgcagctgagcaccaaacaaagttggcctacgataaataacgattaattgttgatggtctagaaaatgggcaattctttggaaaccaagaaagaagtattatttaccaaaggacaatgccatctccaacagcattaaagagatcattcgtgtttgggttcattgggatgacatgccgacaatcaggatcattttccagggctttgtttatccagttgacaaaggcatacttttcttcctctgcaagtaaatgattaaagtgactcatttgcaaagtgaaactctattataaacaaaattatgcatgtggatcttaaattctcattcccagcagagagatgtgagtttattcagtccattatcttatcatctcatatttattaagatttaaaaatctcagatcacttgggaaataggcattgagtctgtgtactccaagtcataaaacatagagcaaacagatttaaaaactatctctctgtttcttttcttttcttttttttttttttgagatggagtctcacagtgtcacccaggctggagtgcagtggcgcgatctcggctcactgcaagctctgcctcctggttcacgccattctcctgcctcagcctcccccgtagctgggactacaggcgcccgccacaacacccagctaattttttgtatttttagtagagacggggtttcatcgtgttagccaggatggtctcgatttcctgacctcgtgatctgcccacctcagcctcccaaagtgctgggattgcaggtgtgagccaccgcgcccggccaaaactatctctctgttcctatatatacgcataatccagatatatatttacatttagaagcaaatatatacatatgtttattttctatatataaatacataaataataaaaatattttatttatatgtgcatgtatacatatatatatacacatataaatacaaatgtggtataatgcttacaggacaaaactcaggattccgcttttagctctgctggtttaaatgttggatcactgtggacaatccttattgtacctctgagtttcttgatacaattataattaaattgctataaaataaaatcatttggatataatctttttttcctaacagtaaagctgccagaaggtgatttttagatgttttaataaaaactcaagttatgtcttcacagcctagcactatgtttcccaaactgacagtttttgaaaacagtagtgtccctcagagaaatcctgagtcataaaagtttgggaaatactgtgtagtgaatgtatctccgccttaaagattcacattgcacatttgacccagcaaaggttctgaaaattcctgtatttaaaaacaaaaggccaaacgttgtcttagcaactatagatggtatttaatcatgacttatcttttttttttttttttttttttttgagacagagtcttgttctgtcgccaggctggagtgcaatggtgcaatctcggctcactgcaacctctgcctcctgggctcaagcgattctcctgtctcagcttcccgagtcgatgagattacaggcatgcgccactgcacccagtagaacggggtttcaccatgttgcccaggctagtctttaactcctgacctcaggtgatccacccgccttggcctcccaaagtgctgggattacacgcgtgagccactgtgcccggcctcatgagtttatctttaagatcaactaacgttttgaataattcagttttggaaatgttgcaacaactatactgtttggcctgttggaagtttccattatggctgttggatggcagccttcggaataaatttacaaatttattccaaatcaatgaaaacataattttttgatcacttagcaggtgttaaaaattatcatgaagtttaaagatagaagcttgagtagctaattttgtccataagatttagaaaggaatctgggcagcctttaatgattgtttaaatgctgatcaaatcattttgtattggaccctacccagagctaggactgctcctatattatgtacccagaactgacccacttagtcacaggaaaattgggagtcatccataaagctgtgtttgcttctgtctttgtttacatcccttaggtttgaataccaagtttagaatctgtaatcctgaaatcctgctccaacccaggagttgagcctacctgaataggagtgttgggtgccaacgctagactgctctgaagtaccaccgattgcacaaatcccttccttcttattgattgcttttctaaaggtcttggcaacatctgtgctttttaggccatggaaaatctgcaaaaatataatgtatctttagaaactcaagcagtgatcaagaaaatcacaaaggaaagaatatgtaatgtcgaagcaaggaggtaaggaatgtctttctggatattttttaaaacagaattcaagttccaagtttcaaatgtgtctccttgtattctgcatggtactcaccttgataaactcatcaaagctgatccttccatcttggtccagatcacctgtagccatcaggttttctgtaatttctcgtactctatacccaggcaaaggcaagcaagcagccttgaacaagtcattcaactcattgaagctgatgtatccattgccatcagtatctgtaatgtacacaatatactgaagcttcaggacgattcaggcaacagcttttagagaggtgagggaagactagatggaaggtgaagggacgagagaggctatcattcagacattaaggcatgatcccagggaagagtcagaatctcacaagatgactgttgctactgaataggggcaccagcattactttcaacatccacagtaaaagagtcataatttctataaggtacctctgtttccacaaagaactcttatagaaactcttaaggaaaccacaggtttagtgataaagagtaagagaaagtatgtgatggtattaaaatcaaggaaacagcaaaacagaagacaagatataaaagatgagacttacaaaccatttccaggaacaaactatgtaagagtagagtccatattccatgttttgatagagaaagtcattttattgaagcatatttttcaaaaataagttctcccagctcctctaaacaaatactactggtttcttgtcatctctgaaattttgctcatgttcccatttcattgaatctaccctgaagctactcagtgaagaagagaatgatgcaatttggggtaccaggtctactcaccaactttggcaaaagcttctctgagctccatcatttcctcatcggacactgatcctctggccattttttattgctttaggtaacagatctggagagaagaagaacataagggataacttttgtgcatttgaattcttaaaataccacattaagaagcaattcccatttattacatgaagaaatattcttctgcatcccccatgatttagaactatctttccaaaatgtaagtcagaaatacgctttttctcaatcctccatgtggtggtctccaaagatggctctcaacaatttcttccctctcggtctatacagactgctcctcacatcaagaggtagagcttatttccctcccctagaatctgggctggttttttaactgctttgaccattagagggtggtagaaatgatgtctggggctggaaacttctgcttccttctttttggaatgctcattcttaggatgctccctcttggtacccaatttccatgacatgagacatttaagccacataaataaagaagccaatgaaggagaactgggtgcactggttaacaaacctgctgagatcccatctgacagccagcatcaatgccagcaacctgagagggccattttgggctttctggcccatttgagctcctagatgaccacattcccagccaacatcacattaagcagaagaatcgcccagctgtgctcagtcaaccaaaagaacagagaagacaaaacgagtgatgtcttaagtcactacgttttagagtagttacccagcaataagcaactaaaacacttcacttttacataaatgtcttttttaagaggtatcttcgtgttcatatttaaaattagtatttgaccaagccaacagatacagtttataacttcaaaggaagttaatcaaaattctccatattatttagggatgaacaaagggaagctgaccctctcataattcagctatgggaatctgaggcgctttctaggtgttttcttctcagaaaagcgacagtcttgctgagaaacagtgcttgagtaatttcccttttcctgtgcatcactgctgccctctagtgggtgagaagaaaataaaacagaaaatggatgataatctccatgcccctagctaatccacaccagcatgtttcaaatcggagacccactgaagtttgttgaacttactggtgcagaggggataagtggagtgggagtgtgggggttggggtgtttctaagcatagttatattttggatagttcagggaagttatcgatttaaaaaaaaatttgtgacaggatgttgttttcagtagatttcttttttatattttcatattattctatagtgctgtatttgttcttgatggccaccaacaaccacaccaaacagaaaacagtcttaattaacatcaaaacctgtaggccaaaaatgcattacactcaattttgcaaatccatatccattatccaacaaattaccatcctgccacatacatatatcagtggtttcaaacttttgttccaccaagcaaccctttgttgacagaaaccttacatgtaaaccttacatgtaagcaaacaaataaaaataacaactctgagagtctttggttgaaaaaacccaaatgtacccctgcccctgctatcttatctccttgtcaccttcatctgtgggaactccagggagcatgatttgaaaatcatagaattatatatgtcttcatttaaatttaaatgtattcattaaaaatatatttttgatatcaataaaaattttattttattattgtcttacatatctaagaaagtattggtacattggatcttttaaaggatgacagaaactgtcgaggggttaattgtattaaaaatacaatctcactaacacatcacaataaccctaagagacaggcactggctatctggctttcttgtcatctctctctctccctccctctcgtccttttttctttccttcttccttccttgtttcctaccttccttccttcctctctttctttttcagaatgcctttttccaaaaataatttgagctaagttacaaagatatatccaaacccaagagttaaaccaactaaatgatgtaattgataagaaagaaagcgtaactgaaataagatgatggtcgggaggaactctaatacttaaaatacatgcctaagaccccgcatgttttgctacaagtaggctgaaaatctatctccaagttctctagaagctaaggcaaaaaggaaagtatcatcggttatacaattcactatctatgagacaaaccaattttcttagggcagcagatctgatgtctgacagcaaaatcttcacacaggctttaagaagaggccatttgtgggatggggtaaacacaggttttgtgtttcttacaatgtccttcaatataggctgatggcataggtatgtatattctcattgtatagatcagaaaacagtatctcagagaagttaagatacagatctcaaatcactcagctgggtggagaagcagccaaaactccaatccccaagtcttttctcctctcccaggctgtctactcgggttctctgccttcatgttcctgttagacacacatcccatccatccatttattcactaaacaatgagttctccctctccctccccctccccctccctccccctccccctccctctcccgtctccctcaacccacggtctccctctccctctctttccacgttctccctctgatgccgagcagaagctggactgtactgctgccgtatgggctcactgcaacctccctgcctgattctcctgcctcagcctgccaagtgcctgcgattgcaggcgcgcgcctccaggcctgactcgttttcgtatttttttggtggagacggggtttcgctgtgttggccgggctggtctccagctcctaaccgtgagtgatctgccagcctcggcctccggaggtgctgggattgcaggcggagtctcgttcactcagtgctcaatgttgcccaggctggagtgcagtggcgtgatctcggctagctacaacctccacctcccagccgcctgccttggcctcccaaagtgccgagattgcagcctctgcccagccgccaccccttccgggaagtgaggagcgtctctgcctggccgcccatcgtctgagatgtggggagcgcctctgccccgccgccccgtctgggatgtgaggagcgcctctgcccggccgcgaccccgtctgggaggtgaggagcgtctctgcacggctgccccgtctgagaagtgaggagcccctccgcccggcagccgccctgtctgaaaagtgaggcgcccctccgcctggcagccaccccgtctgggaagtgaggagcgtctccagccggcagccgccccgtcggggagggaggtggggggcagcccccgcccggccagccgccccgtccgggagggaggtggggggcgcctctgccctgccgccccttctgagaagtgaggagcccctctgcccggccgccaccccgtctgggaggtgtacccaacagctcattgagaacgggccaggatgacaatggcggttttgtggaacagaaaagggggaaatgtggggaaaagatagagaaatcagattgttgctgtgtctgtgtagaaagaagtagacataggaggctccattttgttctgtattaagaaaaattcttctgccttgggatgctgttaatctataaccttacccccaaccccgtgctctctgaaacatgtgctgtgtccactcagggttaaatggattaagggcggtgccagatgtgctttgttaaacagatgcttgaaggcagcatgctcgttaagagtcatcaccactccctaatctcaagtacccagggacacaaacactgcggaaggccgcagggtcctctgcctaggaaaaccagacacctttgttcacttgtttatctgctgaccttccctccactattgtcctgtgaccctgccaaatccccctctgcgagaaacacccaagaatgatcaattaaaaaaaaaaaaaaaaaaacaatgagttattaagtatatggactatggatagccccatgggagatttttaaaactacaatatagtgagcttgtccagtcattctagtagaaagcttttgctttcctgtgctcagaaatcaaggcttctgttttaaggaattagtatagaactttgtattaatatactttgctaaatccttgtgactaacttggcttaggtctcttctataccctctaccatatccacatatgcatgaatagaaggctctccagctctccggctgtccagcccttcatgtttttaaatgtcttaagacctcttggttcataggtgtttatgggattataagatacattcattcatttaacaaatattttatgaatgcctactataagccaggtgctattcttcattttaggtaagcacgtctatattgacccagttagttatcctgaaagcatggaacaatgtcaaaggtaaggaggacaaacaagatctctgactctaaacctggccttatcccttgacacaagaatgttagattttagagcgctatcagcagctagcgataaatataagtagaagcagagaacaagactacattctaagtgtcacaagtagggccaatgaagaaacaaaacaattacagtgttgggtaaaaaaagaaaatctaaaaaatatctaaagatcatggtataatgggaaattttttttaccataaaaattgcagtggcccattcatttaaaagacatagaaagtacatgtattttaaaatcatattatttttaaaccacagcaggtaggtcaagatgaaaagccttgagcatctgtaacaatatttttctacgagatttatgagtggagaggataaactcagagaagtcaaacagcaagaacacctttaaatttaaaaaatccaaaatgcttcagtgatttaacagcaaatgcaaaagagaagtggattaacttagtttaaaaggtaaagtggagaagggataatcagcaactgacattgctgtgatactgtttgttgttgttgggcagaaacatgaatagatatctggagagagtcccttttaccatcagcatgagcagcatatcctggaaacacaacctaacttttggagacagaaggaacctcataaataatttattacaatgtcctcattttataaataaggaaactgaagttctaatgagaagaaatgttttatccatgtacaaattctcaaggcaatgccaggctggagcttgtaaatgcaggtgctgatgagcagagcaggaaaaggatggagttaccattaaaagggcccctaaggtccataactgagcagagacctttaagtaattaaactgaatgtgcaaagggcagtaatttcacaaagcaaagcagcaggaagaggacataattagtgtaaaaacaggcagaccagatcatttttaagaaagacattgagccaggtgcagtggctcatgcctgtgatcccaacatgttgggaggccgaggtgcacggattgctttgagcttaggtgttcgagaccagcctgggcaacatggtgaaaccccatctctaccaaaaatacaaaaattatctaggtgtggtggtgcatgcctgtgatcccagctactcgggaggctgaggtgggaggatcacttgaacccaggaagcggaggttgcagtgaactgagatcatgccactgcactccaacctgggtgacagagcgagaccccatttcaaaaacaaaaaaaaaacaaaaatgcacccattttaattcacgcatatttgaaaatatgggttatgataatattataagattaataagtaatataagtaagattagttggtgatggctttagtttgcaaattactggcaccatataggcagcaaactatacagatactgctgcagtaatgggcatgctgaggcatctggagcttaaaaggaggggctaaagaaagcatgtatcttccaaggtataagtgagtggtttcttcagctctgcccgactgctcctgcattgagtgtggccctttttaatgactacatcatctaaatatgccctgccacaaaccattttcaggtcttctgcaaatccgtggtcaatctgggaaatccccttctgaattactgcccaaatcaaaaatctattataaaaagacaactcattcatcaaggtcacgtctgggctgctagttttttgtgtgagtgcatgtgagagcacttaaatttattaaatcaatagttgtagaatctcaagacgttggccaaaaaaaaagcattggttgttcattttaaaaaattatattatttttaaaaccttaagaaaaaaaaagccccacctcaaactgcaaaagccacaaagcctgttcatttcttaaatcagtgagttttgagtttctgcttaaagggtgctggtatttcccaagtcagtagcgaagggaatttctgaggatgagttatcataaaagtacctgaacttaagttctctaaagtctgaatatagaaacaatttgtgggagtttactcttgaacacagtgctgcagaatttacagaagaaaaaacatcctctaaagtaaatgtaaaaatgtaaatggaattttctctggggagtttcataactgataattaaaagcagaaaggctagaaaaggtgacctgtctagagagagatgctcaaggggtggaatcatttctgaaagatggtagtgctgggctagtcagtattttgattcaatatactgatgctgaatcatataacctgccaggatcagggaggcatctgtgacctggtatcaccttgccaagggactcttttgaatgtgccccacttttcctgcaacttgattcagtagttaaagtcaaaccggacactcaggactcaagttcctagctctgcctcaataaatttcagtacatttccagaggggaaattatacaacttccaaacatctcaagaacaatcagtaatccaaaagaacacatcatctagaataacattaatattgtaagctttagcattagactatgacaactaaagaaacgaaaaataaaatatgtaggactatgaagcaaaataaaatacccatacatttttaaaaagccatcaagattaatctatttaaggaaaaaacattgcttttacttaatcctgtccccttcattttataaagtagaccactgtaggagatcttactttgcgaatatatggaatttactatatattcttgggatatcatatctctatggatacagatatgactaacttttacataaaggatgattcagaaaatataattttaaaatgactttgtttttaagaaaccaaataattataaatggccttaaaaacagatggccagttaaagggactctgatgaatctttttgtcaagtcagaatctcctccagattgtcctttttctccctgcagatacatggattctctcaaagcctacagaattcttctctctgcaggctctgatgtaaatgccacagggtggaaggtagggggaaggctattcaggaggagagactcaacggctctcctctgacactattatctcaggccacataaacacttatgggaagctagcaatccagattactccaaacttcatcaacctcatattgctctgggtacctctggtttgaccactacaccgaggggcttctgaagctgtgtagcacatcttacagagcctggctctgtcgccagctaaggagttctcattccttccttctctcccttagtacattcctgatacctctgttttctaccaagttgcccaatcccattaagggtgtgacacaagaacaagcctcctgcaagaaaaggggatactccaggctggggcttggggaggcctttctgtgccttagcatctctctccttccctgagctttagacagtgatgctcctgatactaacatctttaaattctacagctaccctttagcccacattctaccagaagcaatttaagatccagactttcccctactgaaagctcagagtaccccaaatgcatcttttcaataaattgaatattatgggctagctgtttaaccatgattgcactattaccttgatatcaaatgccattcattcattctttcactccatatatgtgtctgtatgcaaagtactgccctggctgctagggggttggtgaggggcttcaggcatgaagcccacagttaaatatcaagtttcaaatgcagcacatggattacagctaatttactgtgaaatagttaatgcaatgaaaagagttctgacgatcaaaaacgaacaagtgaaaaggttaaacacaaggctctgagggaaaaataaaactagataagtgtaagaaattagcacagaggcttatcaaaaaaataaaaatataaaatacctaaagcagcccaggcaattaagatattgagacaattaatatacttgaacatctccaaagaaatcaaaatggaaataactggcaggaaatagaaggaagtgccaagcttggcagtcaggagacctaggctgtgtaactttaggctccatcttgcctctatgggactcagttttctcattcataaattgagaagcggagtccgttctatgttaaaagttccaaaattctatgcagtagctgacaagtatacatacaaattagagctagattagaaagtattgcaaatgagctgagaaatagctgctggcgccatcagcagctgtagctttggctcggaggtgccttctgtgaaatggagcaagtgagggagtgggcagctcccagcccagcctcgctcctgggggctggggggctgtgttcctgctcttacctcagcagcacgaaaagctctgtctagatgcattctcctcactggccccaggcagatgcgctctgctcagctgcctagctgctggactgcccccgcacagatcagggaagttcccagagcagcacgtgagacctgttttatgggatgttaccacacacagcttaagacacgttgatccagttcactcctagtttctaggcaagacggtactcaaactgtcccagaaagagagtcatctactattttgttaaaaatatccaaataaggaaatcctacaacctctctggtgtctcatatccctactttgtaacctaaatcttttctgatacgattgaaggtctctcttgggctattctcagaggaaataacaggagctgttcaattcataaagattccatcacatgccttggtctctttatattcttgtaacctgcttttttagggcttattctccaaatctttcatagttttctttgctatcttctgggtctatgccaacttccttatagaatgaatgtagtaagaatagcagtcatagaatgtagaggtggagggatcttagagatgatctatctggccactcccctgtcacagaggcatgaaatgacacccaagttaaaggacatgcctaacatcacagagcttattggaggtgtggctgggaccagagtccaggcctccttatttctcttctttcctctttaataagttttaaaccctaagataggactcttctctttaattaagaccttcttcacatatagtaagaacaatcccccaagatttcaaatgtcttacgaatataatttcatgtatgtttcttgtacatgaaggggaatttttctaggtatggcaaaggcactgttcaggtttaggctgcaattaacatgtgccaaatcacatacaaatattgtgtacactggcatcttctaggtcacgatgattcttaccccctgcatttgtctctatacatttattctattttttttccttaaagagacagatctcactatgttgcctaggcaggagtgcagtggctcttcacaggtgtgatcccactactgatcagcacaggagttttgacctgctccatttctggtgtgagccagtgcacccactcctccttaaacaacctagtggtcccctgctcccatattgatgccaaacttagtgctgacacccaattgacatggcacactacagcccagaactcctggactcaagccaccctcctgcctcagcctcccaagtagctaggactacaggcgtgcaccaccacaccttgttgtacattgattcttgaccttgcactaaggccctccaaatttccttagcaaccaaagagcaaacccaattaaaacaactcaccacgagatgaaatgttcaaaagacaagacagccaaattcatagatcaataataaaatgacaccctcagacttatcgcaacaatcatcatggtttcaggcatcctgttctggaggctggggagaatcagtgagcccttcctctgagctttggtccagatctctgtagtgtggtccctgttaccattcatctctcctagcagattagtgtctggcccatgtgaggtactcagtaaatgagctgtgtacatgaacaaaacaatccataacctaatggtatacaggacttgaaaagtcccctatcaccttctttgaggaatttaacaataatattcttgtgtacatacttagacaatcccatccactgaaaggtacagacacccaaaacaaggctactaaatgcttcaaattcacattaaaccactttgctggaaagacaactttggtgagttaatttggtgtctaaagggcagctgctggcccgaggtagtctgtgaaatggcacctgtgcctgctgcctagccctaccttgccagccgcaaaagcgattctgtctgagattgcagatcctgaggctgggcttcttggcactgttgctgtaaaacctgctggctgccggtaatgcttggcagtgggtctctatccaactctgtagggcctgcttgtaagctgagcgctgctgaggtgggagggaaaggaaccttggagacagagcagtgactgaatgaggggcaaacccacctgggatgcacatatgcggtgtaccaaggagcaagctggaaatataggtgctagcatttacctgcatgtaatttgcgtctcactatctgaacaatgctattcatcccccagtaattctaaatgtctgtcactaaaaaaattcatacatttgtaaatttcttccttcaatagacatctgccaaacacctactatatgccaggtcctgtgttagatgctgagaacacacagacgtggctttggcctgttgagtaggggagagagacacagtaactagaatacagcgaaactttttagatccacaggaagagggaaaaaatagctctcccctggagagccaaaggcggccccctagaggaagtgacatttgacctagatttcaacagagcagtaggagattgcttaaagatcagtctgtttttttcttcattcatcagagactccatgctctctctatagaaagcctatctatttggagtcagagaaagggcaaatagctaaagaacaaatgaaaagaccagttggtcagtaataatagccgttaacattaatgagtggttaactcagtgctaaatgttttacatgcattcacatttaattctcaccacaatcctatagggtattactatgattcccactttgaggaaactgaggtttaaatagctggcccagggtcgcacagctataaactggagtggcctcctgcctttcctatcatttctggctatgggattcctgtatctcgagtttccctgccatcctttggggttgcccttgaaggtcaaagctctgacctcatgttaattagggaaacacatatttctgcaaggttttacttaggactgggcccttcctaggctctttagggaagttctaaatgtgtcttcggtttctcaacatctttaaaggaagtattaagaagagcaagaacacaaccaggcttgatcttttctgcctgtgtcccccctgccactggtggagaaaagggtcctctttgcccgtggcctccacacctcagtcattcactcacatttaataaagcacataccttgtcctaagtactaaagataccaagatgaacagcagagaatccttgctcctgaggggcacacagtccagtaaacaaaatagtcacgcaaatgcaagactacactaatatgaatattttaaagatattatttgcatggagctacaggagcacagagaatgaagtgcagtggacctatgaacaacacaggtttcaatggtgtgcgtccaattatacgcaattttcttcaatacagtcagccctcattgtcctcagggtcagcatctgcaaccaaatgtggatggaaaatacaagtattcgcagaatgcgaaactcagggcgaccaagggccaacttttcgtacatgtgggtaccacagggctgactgcaggacttgagtatgtatggattttagtaccgagggggttactggaaccagtgccctgtggataccatggaacaactgtatttaactctgcctgggaaggcaaaagaaggttttccagagaaggtgatgttgcccactgagctaagtcttagggaaccagtagttttccaaacagacaaaatagaaaagggcatttcaggcagagaaaatagctctgcagggcgaggcatggtggctcacgcctgtaatccctgtactttgggaggctgagatgggtggatcacctgaggtcaggagttcaaaaccagcctggccaacatggtgaaaacccatctctactaaaaatacaaaaattagccaggcatggtgatgggtgcctgtaatcccagctactcatgaggctgaggcaggagaatcacttgaacccgggaggcagaggttgcagtgagctgagatcacgccattgcactccagtctgggccacagagcaaggctccattacattaaaaaaaaggaagaaagaaaagaaaagaaagagaaaatagctctacaaagtgcaaagcaaaagcacacacaggaagctgtggcaggttgggtgtggctacagacagggatgcaggaggagacctccaggatgagaggttggtgaggtggtgtcagcgtgctgctcgttctcactagctcttgtttctagaggcaaaacctcggtgatgcaggctatactccactcaccacaggtaatgtgaatacaaacaacaaaataattctgcccggaaaccattttggtttgtgtgtgcatagctttctccttatgtcattatctcccatttagaaaatactgcaaagacaggagggaactgaacatgttagaatggggaaataggggccctggagggtgaagtcactccccaaagtctcaaagtaagtcagtgactggtccaaaaagagaagtaagtggaacctctggagtcttagtttggtcgaagcaatgcgtgggaaaaacacaagtcagttggcattttaagaacctaaagttttatttaaaaaacctttgagatgcacggtccatgaaatgtgctttacttcttagatgtgtggatctaggatacagggatacacccatgtaaaggcattccaaacaaaagctaatgttcctcgcttcctttatgaaattaggatcattatatattgtttttaaaatgaatcaactaggcagtgacatggtatggtgaaatgctgaattttctgactcaactattttttgctgtgtgtatttgaatgtgttacttaaattttccgagcctcagtttcttcatctttaaagaaggggtgctaataatgcaatcacaccgttcatttcatagggcagcattaggattaggtgagacagagtgtttaaaatatatacaacagtgcctggtgactgaagggagaaagagaggaagagaggaaggaaagaaagaaggaaaagggaaggaacagaggaagttaaaagaaaatgtaaaagaactagaacttttgcaaaattatcttggagaacaaatcccaatttctagtataaactgtaggaaatattgtcaagtcgcaacttaaaagcaaagattagttgtgttgtatactatgtgttttgtgtgggtgtaaatctagatctcacatccatgctctatgttttaatgttctcagtctggcttattttggctttggtaccacatttcttattcggagtccttgaagtcaggtattgcagaactggtacatgataccaacccaaagccaacagcattggtattagctcatcctgagtggtgaaggggctccgggctttgccttgcctgagtactgacagtggaaagtaccttctaacagttgaggaagtatggccagagtggaaaaatgtacagcaatcttaagaaaagcccaaccacatacactatgagccatgaaaagaaaagagatctctgggcatctgtgatgaggaccactgggcaacatctcctctctgtcagatgcaccaatgctcagaactgattctgttatcctgcactacactctacctcctctccactctctaattctccaggcatttttaccattgtagtctgagctgaaaaacagtgagacaatgtacagcagacatttgtatacaagcaatgataacagaaacttctatttatttgtaataatgtgatctcattctcaataggcttcttggattttagaatctctaatgacaagcttatttgcagaaaaaaacaaaaggagaagttacagataaattgagacaggaaatttgtattaatttgatgggctctctttatcttcattttttttaaaagttacagtttagttggtaaatatttaccaataccaacgtacaatggaatatgtataacatttcttttatcaaaattttaagtgcctaaatagcctaatctaatatcttcacagctattattttaaagacttcccaccataaaatcctcaagcatttatatttatttctcaaatatgtttggtataccagccgacctaacaaaaggagacttgggatctcttcctgatagaacatgtggaattataggccgggtgcagtgactcacacttgtaatcccagaactttgggaggccgaagtagggggatcgcctgaggtcaggagttcaagaccagcctggccaatgtggtgaaaccctgtctctactaaaaatacaaaaacattagctgagcgtggtggtgtgtgcctgtaatcccagctactcaggaggctgaggcaggagaatctcttgaacccagtaggcggaagttgcagtgagctaagattgtgcctgggcaacaagagcgaaaactccatcttcaaaaaaaaaaaaaaaaagaaaaaagaaagaaaatgtggaattacaaataatcattcaataatcatggaaacacaaaaaagtatatagacatattatcaggaagcaactagtggatcatgttagaagatacaaaacagtttaaatagacatggattatacttttaagaaactgccaacataaaatgagagagaggaaaggtgtgaatcttgactctgccagttactggttctgtgaccccagacaagtcacttaaccctccctgaacctcagcttggtcatctggaataaggatataattaataacaactttacctagctatgtatgaaaataaaagagtaattatctttcaagcgtttggcatgatgcctagtaaatattaggggctcagtaagtcagtggtgacgctgggtggagtagatatgctccatatctacctagacgacaacatgggaaaatggaaggggaaaataacccacatcacacctagcgagtagatagcacttgcctgattttatagatgaggaaactgaacttcagaggctccagagacttgctcagcctccacatttaccaagagcccagaatataaatccaaatctgtctctacctttgctcccctttctttataccacatttgcctcttttgtgcctgggagctgcagacactcagctttaaagaactggtactggagatatggtactggaggaagaactgcgtgcagtgaacagtagggtgggtacggagggaggagaaaaactgtgtgaacatcaccaggtagatgaagtatcacaactgtcattctcagtggtcacagaaaagaaacagaatccatgatattttgaggaacagtcccaacatgaatgacagcaagaaaaggaaaaaatccaaagttttccaaggtgcctaccatattccatattttcaaagggaaactttaaaactgtttataaagcattagaaacagtgggggaagttcagttcgcatttttaagatgacaaaagagtgctcaacagtgcaaaactacaggcatgatcttctcttttttccttactcccactttgcacctattacctagctttctctataaagaatttatatcccactcttctttgttcaagctggcctttctggtgagggtgatatgagcagatgatgtcaaggaggtacaaaggatctactttttaaatgttacacctgagattactagaggctgggaagggtagggggaaggtggaggataggagagatttgtttagatacaaaattatagctagacaggaggaataagctctcatgttctatagcactataggataactatagttaacagtacatagttttaaaatggctagaagagaggcgattgaatgtttccagcacaagaaataaaaaatgtttgagatgatggatatgctgattaccctgatctcatcactagacattgtatgtattgaaacattactaggtaccccataaatacataccgttatatgtcaatttaaaaataaataaaaactgaaaaaacattttcaggatggaagctatattgaatgcacacacatctattataatctcatgaattattataaaaggtttttatggaaaaaaagttgcacctgaggttaataaagatccacttctaattttaaactttgcctaaggaatgctgaatagggaaaatatgcaaattttatacaaataacatttgtgtatccttttacttcacacatttggatacatagcttggataaattttagtgactactaccagactgaggaaacaaaatgcagggtattatttaaatacaaggtaattgttccattaattcacttccctctagaaagtgcaaccagaaaaagaaggaaagcaaattatctgggagattgcaattcacatgcataattaatctgcttgctgaatttggtgtcagcttttctgctatggaaaacataatctctttttcactttagcttatccagtcaagaaggagtgtgtgagtgagtgtgtgtgtgtgtttccgtgtatgtgtgtttatttgtgtgtgtgtgtgtgtgtgtgtgtgtgagagagcgagagagagagagggagggagaccctcccttctgtccatgtaacagatgctgaaataagaatcaatgctgcaaccacagaactgtgggtttgctagttccccaatttaacatagcttttccttccgccagaaagaacaactgaccatctttgagtaacaggctccttgtacttgcaagtggggctgacacagccatggctctgaagttgagcaaaacttacttaaacccagtaagtggttcacttttacctctcttcttccactaacatttaaagcaatgtttcattctttctcagtttttaggacacttatatttggccattactatacaatcatagatatgtgtacttgggtataaaaagtagaatgtttaatctattcatgtctatcagtcacaacagactagaaaatgtgaatgccacttgactaaaattattctaaactttaaaggccgggcgcggtggctcacgcctgtaatcccagcactttgggaggccgaggcaggcagatcacgaggtcaggagatcgagaccgtcctggctaacaaggtgaaacccgtctctactaaaaatacaaaaaattagccgggcgtggtggtgggcgcctgtagtcccagctactcgggaggctgaggcaggagaatcgcttgaacccaggaggcggaggtttcagtaagccgagatcacgcaactgtactccagcctgggtgagccaggaggcagaggtttcagtgagccgagatcgcgccactgcactccagcctgggcgacagagtgaaactctgtctcaaaaaacaaacaaacaaacaaacaaaagactaagaaccttttaaagtttttgagggtggagatcatgttttgtgacccatgcagaggcctgtaattgttaacaaccaacttctactcagtcaagtgtacagaggggctgactactgatgctgttgctgctgctgctgctgctgatggtgatgataatgatgatgatgatgatatgatgacacagaataatttgtttataaaagcacttatcatatagatgcatttatttggggaagtattatgattatttgagctcaacttgagggcttagttacaaataagcaccatggtttgctacctgtttattccaggaagttgccttgaaattcaacagttaagacaaaattgatccaattgtagaaaattaaataaaatacgtgaatgaatgaacttgccttcaaatatgaagaggacaccagacactacctcacaggactgtatgacaactaaatgctttcatagggttaaagcacttagaaaaacacctgattcaatgtaagtattaacgttattattaggatgattaattgaagcgccttccactcccccccatcccccaccgatatcttacaagatggagcagttatgcaatttctgggcagactgatgtaagcattgaaactgacaaaccaaaacaacaggaacagtcaatagtataaggcaggaagttggatcagaagggaactgaggaaagcaacaaggagatgccatctggggaacaccacggccacagcagctatagggagatatccctaggaaaccaacatctaatcaggaggtgacttccgagagcctcaaaatgaagaccctgtagaacattaacacttttttaaggagtgcgcttccatctggcaaaataggaacacttgaaactcttcaaatctgtggacactgattagttttatattttgatgtgtcctaattctaatgtttatttctgcagtgttcagtatacagatgaaatagtatcatttcatttgatatctgtaagttgggaaactagcagataaaaaaacactaggaagaaaattagattaactgaaataatgtcactctactataaaatctactattagtaataaagtccaagcctttataatcttattttataagtgtttgactcttcataagtataaccttataagcagatttcttaattttattttacctaagctgattttaaaagttgcttgccatctctcctgtatacacagaagggcctgtactctttaggtaacaaggagaagttgacttgagaattttctgagaataatccaaagtgactaagtaaaagttaacaactgcccttgtgttctttgtcatcaaagaggcccattattgggtatatagttttggcaagggtagctaagttttggcccaaccaatgtatttatactaaaaaaatgagattgtaattttccctgtttgttagtcattgtacaattttttaaatttcttgaggtcaatgtctatatgatactttgaagctaaaatgagactagggcttcggtaaagctgaaacatggtagaatgcaaaatattatattattgttgcatcttcattcatagcaataaatggaaactcagtaaatattaagttaataagtacaatcaaagtctttcatgcgtatgtaagaagctgagaaaaaaaatacttgtgacaaattttcaattcaataaatgcctttagtatctacatgtgccaggaaagatggagaaggagctcaggtctgtcagcaaataagtacttgaaactaagacaatgtgattaatgttatacttactccaagatcaaagcattgagcaaatgcacaccaaagaaacatttagtgggggcagggagaagatgggaaggcctccaaaagggtatgtttcttgaagtccgccttgaaaaatgatcagaagttttaaaaataaagaagaatgcaattaaagaaacagttgcagtgaaaaaaggtgaaagagaatggaactttctggtggcttgtggtctggtgcaccaaaatgtgggttagcagtggcgggggaggggatggggtagtgggaggttgaacagaaggaagtgacaagaaataagattggggaagtgggtcgaggcaagtttgtaaaggcacacaattctttagtaaaattatgcattaatttaaaaatagttcttcagcccattattatataaaacctgcaatggtatctcttatttataaaaataaaaatgtttgtaaatttattacaaagtttttcttctctctctctctctcttctttctcttgctctctctcttttattctctcttaaaactgtgagtgccaagatcttgttagctagcttcagtaataaaagtctataatcacctacctctgagaaaaatatgctggcctggaagggaggatctgtaacacacacagtcagtaggagcctgaaatcctggccatctactgccccccaccccaactgcccagtgacctatggccggttccttcaattatctagcccattccttatctctaaaggtagctgagaggattaaacgaggtaatgcataaagagtagctgcttacactacgtgctcataattattgagtgctattattaatttcctgtcctctccaagttaaatggtactttaacaacaagtaaatgagactttacttgttggtcttcccttccccaaagggttcagagatagaattataaatgaagttaaagcactgaaattgtttcccaaattaccaattgtttcaaggcataatttacaaaagagacaaaaatttaaatgctacaaagaaaagggtctctgggattgctaaggaaatgtcctcctaggcacaactccatcccaccacagcagtgcttgttcaaagggcaagacctagaagatttttcccctgatgttcctgggggtgagctagaatgaagaggaatatctttgtaacatatggggttgatgctttagcaatgtaaacttaactttaaacaggggacctttatattttgaattaactttcgcatagttcttttttattccttcgtaaatataagaaaaatactgacattccttcacattcgaatttattttattctcattaatagttttacttaaaataagacacaacatatttttagtctgttcttttacggggttcaagtccctcttatctcagtttcacatttttgcttgtttgaaactattcaggtgagatgtgcaaagtaacattggtggtcacattttgcagtttccagaaattcacatttataggtaaatgattaattctattcaaatttgtctacacagacattctttaaacaattatacttaatagaaaccaaacttatgacaaatgtatgtaaattcaaaatcaagatgtgtgtggataagccacctttatttgcttactgatagttctgacagagtaattttagaaaacaagttgctgtgtaaaagaaaagttcggttttgataaacatcctgattaatgttcgcatttccagtctgaatggcttttatagttatcatttgtcaatggttcttagtgttatgtgatagtggtaattaagtaaaagcttatactacaaaatccaaagtgtctatgtttgggcagtttctgaaataaatatcccatatcaactgtgtaaaaatttctattgtagataaaagcctttctcccagaatttgagtgaatattcattgatatggtcataagcataacaaataattcagacaatcctacaaaaacactacaattaagcattatacaaattgcttttatttttagagaacaaatggaaaagagaaaacctctaattccatgtggttataaagcacacccattaaaaacccttggcgccaaaaatcactcaaataaccagtatcacattcagtaacatatgactctagataatttatccactaaagtactgtaaagaagttttttagaaaaacagaaccgcaggaactaaaattaaactacccccattgggccaataagccatacaatctaaattatcaatacgcgcttttcctgaaaacattttaaagaagataaaatcacagtaaatagcctccgtgaaatagagcaatagaaataaaccagaacatggtttggttttaaaaggaaaaagaaaccttaattttgggcaggggtgataactgcagataagttgagaagaacccagcccagagagccgaggtgctccatcttggatggccacgcgaggtggcggcagatgtcctggccagttagacagtggcaggaatcacagaggtctcaggtgacatgctcagatctctggtcccctgaaggcaaaacccacaatccacagaaacagtgccgaagtgcatcacaagcgcttaaaaccaacaaaaacacatgaagaacatttaccttgcaggaaaaaagctgtccttggtagtactggtgtatgaccaggaaccccttctttctgatctgcagaacagctttgtcaagcctgggtgtgtggtcacaaggcaggaagtgactagaatgacaaatcatcagccaggaaagaaaaagattttgtctttataaggacattttaacttttttttcatgtccccgccccaccaaaaatcacctg

SEQ ID NO: 994 - DNA, 52010 bp, Homo sapiens
ttgggaagagaagtacctttttaatagatatataaattatagttatttaacttagaaaacaataactttagtgtttctagaaagtagatggcatttctaaaaaatagttacatacacttgataaagaacagacattccttctgaatttagaactttatgagttattgttataattagtaaggctaaattttaacacaaaggactataataaaacattctttgaatattaaaataattcccccaaaacctatattaagctttacaaatttcagacaagtcattccatctgaaactctgtccaagatatacatggctgtgagtaatgtgtttctgtgaaagtcttttggatgaaaataatgaactttgggttttagaatatttgatttactgcctttgggttcctctgctgcctgtttctcttgctaaatattcagactgagactttactatgactaatcttactccattcttggacgttctgcctctgcagtggggaaggagaccctcctggattatggtgaatatttagctctgaatcaaatgaatgtttaaatctctaagacttgcagtaatgttgaatttggctggataccctgtggttataatattttaagcctttaaaaatatacagattctcaaatagcgacaagcttttttcctgattttttttcctgcctagcaactttgttattatcctcactgtctacttcaaacaaactgtatgcagtttacaattcttgtagcatatggttgctgcctacaagcactttgtgtgccttggcaaacagccacatgcaacattgaagaatggtttcctggatgagtactagagaattttgtttctatccatttttctacttgagttcaactttcaagatagggttgggttagacattgtttctttcttcccttctccctccttcctttcttccttccctttcctctctctccctctcttctttcctgtttcattgttgcagctatcctttaccctaggtaatttatgttgtcagtatcattagaggttctcatcaagcaatgttaatgtaatactcatgttgacaaccccaagtgtttctagcttttgccttctcctgaatcctcacctatatttcaaatcattttggttaaaatccattggtttttttgttttgtacttctggcctaaagagaaatcctcatggcagaaaacgtgttggtttgtaagcctcatcactgatattgagacccagtgtagatttgtgttttggaaaaacaatagctttatttagcattaattgagatgagggctgggtgtaatttcctgctacaaaggagaaattgggaaggaaggagcagaagcttttagaatatagaatgggtctgacagcaagagatgaatattatgtcttgagacattggtagtgcaagaggcaggggatcaaagcacagccccttcttagtgtgaggtcccttaacccctcaatccctagctcccctttcccacttccaaccgtttccttgcaggaagcctggaatgggatgccctggcacatgagggggtggcaaagcaatgggctgagaagtgtaggagaagcagctccaagaggtgagcttgtgtttctcttttctgttttgggccccttgtggtcatctttgtgtccatgctgtctgcacagattgtagtctaactgcttttctgccatttgatcaactggttgaattcatttatctaccattgggttacttatttttgcccaacataatgatagcctaaatacttatagtccgaactctcttcggatttatagagcattagtcaaccatagtctcaagtgcaagtaagagatcatttttttgattagcatctaaatattctgcattgagaaaaatgcattaaggggtgagagaaatgtatgtgtaataatgcatttatatatacatatagatacgtgcatatatgtatataaacaaatattcacacatctatacatacgtgtatatatacatataataagtacacacgtatgtatatattatgtatatgtatagtttaaatgtaacctgggcatccataaattactatggaacttgttaaactatatatccaaataagcagaacatcacattttcagtatttatatattgcagtggaagtctttaaacatcaaatcttactggtgattaacaaatttaagtattatcttaacagaaaaggaatataaatttgctatctgtatgttttgttgccctttgggaaaattatactgtcaaccagtgttaaatagaaaaccttcaaatcagctataaattgacaacaaatagcaaagtctgaatgaatgtgttctgcctaacattaaaaaatgtcttgatcctaagtctcttccatttgacatctctagcccttaatgcctttttcggaagacaagctgttatgctgaatatgcaaagaggcaggaagaagcctctgaaggcacggtgaggcttagtcgacgccttccagattggtgtcagccacgttgcgcggctggggcccagctgaggcccctactggcagctcctctgctgctgctcgtgggggctgcctactgggctcgcatgcaggcaccatggctgcaacgtgctcttctgctgcgcatgctggagcaggcacatctgcctccatcttctgtagggaggcctcggtgggagcctgtggggcctgaccggaagcttctgcctctggcttccaggacgcctgatcagcctgtgctccaacagggagaccctcgcattgggtttctgctcccaacccggcaggagaattactggccttggagggaggttcagcatcactgcctccttcggcttcagcctgaggagttaggggaggcaggggactctctgaatcccgtgaagggatcagagggggttgctctggctccttgagagcggcgtcagcactctcctgagaactgcctatttcgggttgggtttctttggactggtgcggggttgactctggatgatgaattatcatgaaggctgtggccagatttttcacggcggtttggacactattaacctcctctgcgtcaatctcttgatccacagagacgtttgactctggctcttcatcggagttgtgctgactttggtcatccttttcagatatttctgcgtctctgatttttttgtggagttcgtttctctcttcttgtaaagcacggcagaggttctctagcctcccgattttcatcacaaagcactcatattctttagctctcagtgctttctgtgatgtgaaaacacacgcacatacacacacagatgaaatgacatgataagcaaaatgtccaggatgctttctggaaacaagcaaaactatttgtcccagaatttgtctactaggctctgggacctggctacagagtaggggctgaacagatgcttggtcatggacatcactttccttttttttttttttttttggcattgtgtactagactggtagattctttaatcaccataccctgttcattgggaaagaaagatggtcaggcttccttctgctttggtccatagcctctcaaatcttatggatgaattttctgcttctgagacttagaaggtagaagcaagacttgcggcaagataaatgagatggattgggacttgggtttcagcaatgccttccttatctgttctatgaataaactgctatgtgctaatcccagcagccatttgatttatgttgatgagtaatatctctttggaattggttgcaatttgagaagaattgttagagcagtaattataaccatagaaattcaccatatactaattcacgatgctggctgctcaaacggttcagttttttcctctagaaatgtctatttgtgcatgaaaatgttcctaattatctcactccttcacctcacctctgagctactctgtccctttgagaccttttttcccccactcgttatacatggagagaccttcacctgtaagccctacctctcaggtcaggggccatgtatctttgcctttggactctcaaaacctacttggagcctggcatgagatcagtgtttaaatgtctattggaggaattaaaaagatatctccatatctgtttatattagaaaatagcacatgcactggactcttgggctggtgtcttctcgcagtatgttcaaatcaactaattaatttattcagcacctgttatgtgtcagacactggggaaatttaaagtaaaataagacactcatcctacctttaaggaattcacagcccttaaaggggacagctgccctgggtacagctattgaatcaacaggtaagcatgtgacttagggtcacaaaactctttctgagtctggacctgattctaaatgacctttgctcttattatacttattacaatttaaaatgtcacatcctgccaccccaaattcaactctttttcacacataaccatttgtactattaccaggttataattgtatcgtaagtttgaatgttttgactagacagaggggattaaagctaagggagaaacttcctcacctcttcaatcatgtccaacagagctttgttacagttctcaaatcgggctttccatgtggctgtgtccttttccagcttcttcattttcttagttgtctacagaaattagagtgagtgtgtgttaatcttgaaaagttaatatatcaaggaagctattagctccatatgtgagaccaggagaagcccttttgttaccagatgctgaagcaaacaaatgttcaatgtcaagaatgaagattgtagcagagtcataatttatttctgagccgtctagggcagtggcaagcaaacttatttgcacctgagccaattcaggaaatgggaaatgacttaggggcacatggttttgtcactgctttttctttcatttaaaagaagaatatctttatggagttccatgaacaagcctgtaatttaggatatttactgtattgaatagaagactatcacagtgggaaagctggcatggcctttttagccattaaaatgttgataatatctgggcacatctgagaagttgctgcacaaaagcagtctctgtattttctgggtctttacatttatagagtgaggtagagttcacaaaatgtgattacatgcattatttgtttcatccttgaaacagtcccacaaggaaggttctattttcacccccattttataaatggggaaaccgaagttcggagaggtagagtaatatttaggtgaattaacagaacagtggggctgccattcttttatttcatttaatgaagcatatagaatgtctggtggtcaccaggccctgggctgggtacgaggaagtaagaagtgaataaaatgcagcctgtgtttttcgaacctgaggctactcacattcttgtttgtaggatctcttctttgcttagatgaagtggagaacgaggcatgtactcaggtgcagttttcctggatgaaacatagctgggcactcgctgcttggtgccaagctgcctgaagctgggtacccacggaggccagaggctgggcccaagactgtcagcccctggctctacagacaagctaggtttttaattttgatcatattttaaattagttagtagtttgtaaacttctttgttttcttcttttttgttgttgtttgtttttcactcttttgcccaggctggagtgcaatggcgtgatctcggctcactgcaaactctgcctcccgagttcaagcgattctcctgcctcagcctcctgagtagctgggattacaggcgcctgccaccattcctggctaatttttttgtatttcagtagaaacagtgtttcaccatgttggccaggcggtcttgagctcctgacctcaagtgatccacccgcctcagcctcccaaaatgctgggattgcaggcatgagccactgcgcccagccagttgtttgtaaactttaaggtcatcaatctttttaagaatgtggtgaaagctatgggaccacacttcacaaaaatgtgcatatgtgcatcatttttttttatggtaatttctagagagttctcaggtcaactactaacgtccataaatggacccaagattaagaactcctgatttaatatttattccactcttaaaactacataattttgaaaaacatgttttcctgttctaatttattccaatcttaaaatgctagaatttcaaaaaaaaattaagcaaatggatagttccattctgaagtgggagaactgtaacatttaacaagtgccaatcttcttcaggttgctcattgtaaaatttgtcataatattttaaaaatatattttaagaggatgttttctacacctcaaaaccattaatgccaatccctgttcggaaacacagttctgatggctgattttgtattgggaagacactgaacaagctttaaacattacattaaattataatactggcaccttatatttgaaaaatacatgtaaaaagttaaaatcccttccaaaatgtattaatttaacttcacaatcttgtgagttaggcagggaaagtagtatctgcatagattaaaaaaaattagaggccaggcatggtggctcatgcctgtaatcccagcactttgagaggccgtggtgggtggatcacatgaggtcaggagttcgagaccagcctgaccaacacggtgaaaccccgtctttactaaaaatataaaattaaccggacatggtggtgcatgcctgtaatcccagctactcgggaggctgaggcaggagaattgcttgaacccggaaggcagaggttgcagtgagccaagatcgcaccattgcactccagcctgggcaacaagagcgaaattccatctcaaaaaaaaaaaaaaaattagattcaggaagttaagtgaattgatgagtaagaccacttgatgagcaagaacacaccagaattgaattcaggcttccatcttctcattcaaggctctgtcagttatattacattacataagttaaattctcttctaagaaggttcttataagatggtatttcctattctaacattctacttttgtatattcatataaaagttttttggttttttgtgtttttgttttgagacagattctcgctctgttgcccaggctagagtgcagtggcgtgatctcactcgctgcaacctctgcctcccaggttcaagcgattctcctgcctcaccctcctgagtagctgggactacaggcgcatgccaccacgcctggctaatttttgtgtttttagtagagacagggtttcaccatcttggccaggctggtctcgaactcctgatcttgtgatcctcatgccttgggctcccaaagtgctgggattacaggcatgaaccaccacgtctggacaaaagtttttgtttttttttttttaattcttagaaggttatattttgagttcagtatatacaccatcatgttaaattgctagctctggtcttcttttttttttttttttttttttttaagttatccatgggttagaaaaagaactattcttcttcagagtgaaaatgaaacctagaatttttggactcctgctaagattaattcactagatacttaccaattaaaaaatacagcccaaacctcattcctacctataaacatttcattactttgtgaaatgcaccaaaatatcttagtgagagaaaaaggaaaccaaaggaaatttgcctgtcaaaatagaaaatgtcaatattttgttggtgataagcaatactcactttgtccatttcctgtttgaacgtggcaaacacctcgttgcttttagttagtgtgctctggaattcttcaaaccttcctgagtagagagtgagctgtaaacagaggaaagagtggatctttcagaatacttccagaagaaaacatgtcattgttcattatttaaaggaattctcaatatagtattagtaatatgtttaattattttatttactacaagattaacctaggccagtgagcatgattgaaatgcttctttaaagaaaaatggaaaaatagtctgggcgcagtggctcacgcctgtaatgccagcactttgggcggccaaggcagatggatcacctgaggtcaagagtttgagaccaggagaatggcgtgaacctgggaggcggagcttgcagtgagccgagatcgtgccactgtactccagcctgggcgacagagcgagactccgtctcaaaaaaaaaaaaaaaaagtttgagaccattctggccaacatggtgaaaccccgtctctactaaaaatacaaaaattagccgggcatggtggtgggcacctgtaatcccagctacttgggatgctgaggcaggagaatcgcttgaacccaggaggcaggggttgcagtgagcagagatcacgccattacactccatcctgggcaacaagagcaaaactctgtctccaaaaaaaaaaagaaaaaaatgaaaaaagaaaatatgttatttcattatattaaaacttttatcaacattgattgagtactacatgcatggactgtatgtacagaagtatttaacacatggatctgcatttgagggacctgcacttctaatgggaagaccatctcaaagacaacttgactatgggacaatggctacatagtcaagtcagttaaggacagtgggtgatcggagaaggtgagcatggcaggtgatcatgtgagccacatgtttatggagaaggtgaacctggaacttggtcttgaaggaagggaaaaaatagacaaatgaaaagacgtgataaaggcaatgtgggctggacacggacaagggccattgccatgacacaggttgtacaccactctaggcagttgccatttctgtttcagacatcagagttttgtatgtttatgaatatagcattctagccaatagcagttaaatgtccctttttatcaaaatcagtttattacatcagttttccacagatggaagtaatgagtcttgaaaaagagatgcctttttctaatttgcagagaagcattgtatgggttagcatttgccaagtgtatggctcaccatggagatatagcgaggagcatttgtatcgccaagtccttaattcaagtgcttgcattcggggtggaaatggggcaacacagggaaggagagtgtgtaaatacttgatcagtgatataatgacagtgataaaataataaaatcttgtctttgaaaataatattagggtagcatgttttgaataagagaggatttagtatggatgattcagattggtcaagcctcaattttcaaatgaatctttggtactcttgagtgtccagaatagtcccaagtcttcaaatgggtataacattttcatacaacatagttttttgtatgaagaagcagacttgcagcatccgtcaataaacaagggccctggctgcactggatagaccaggaaggctgggttatcagctggaaggaaggcaccgaccggtgttatcagtgagactgtcttttttaaagtacagaaagcaccctgaatgaaagctggcagattggagagtttccagtcttggggtgtgggtgtgagagggagtatgtatgagtcaaacaacccctagagcccagaaaattgcttatctagaatgggttttccccaataatttggagtagtagagattttactgcagtagacagcaataacataaatcatttcggtagaatacagattatccaaagaaaagccaaatgacagctgattatcattttgaattctctcattagtactgtatgtgacagaaccgaaatttgtttctcatgattccttgacacacagattaaagaagacagagtaaaggggcatcaaggaattcatggccaagaaggggctctagggttttacacacacagagagacacacacactctgtctctcacacacacacgcatggtgcataagacaatgtttactgtggttttttttttctttcttttaagagacagtctgattctgtcacccaggctggagtgcaattgtgtgatcctagctcactgcagcctcaacctcctgggcttaagggatcctcctgcatcagcctccagagttgctaggactacaggcacatgccccatgtctggcttttttttttttttttttttaacacaggctggtctcaaacgcctggcttcaagcaatcctcctgcctcaacatcccaaagtgttgggattacaggcatgagccactgtacccagccaatcatgtgcaatgcactctgacatattctgttcaactgtgttttttctttctttctttctttcttttttttttttttttttcaaaatactggctggaatccactgtgggccagaattaatttcagggcccacaaatgggtcagacctcttggtctgagacactgtgccctagggttagctcctggggactggctacctatcctgtacatcatccattggcctagggtgggaacaactacccccagcagatcctggtcaccttctatcacaaaatcttttcatttgtattctcagcccggcctcttttgttaacttttttccttaatttctccccattctttttccaacttatcagtaactctagcagagttacatagaggcctcagacactgtggtctcctcagctggtcctcccgatccctcttgcagccctgtagttgcaggctgcagacagacggggcaggagtgagcacatgtctggtccatctcacagatgcagccttgctggaatcagcaagaacaaccacccccaggacttcagcctcaacatgagctaacaggcattaaaagccctcaggtttgattgtcttcacttaactgggtaaggctgtcaccatgtcttacttttccatgtgtacctgttatattttttcattatgtctcaaagtaaaggctttaaaaaagaaaaaggcagaatgttctttgtggtgtattaattgggcagattttgtttccttttcttatgttttcttgttgctggctcatgagcatggagaagacagacacacccagagttctgagaagtagtgtcttgattcatcaccagctcttctgtgctttttctagttatggttttcatttttgctttctattaaaaaaattaattgtagtaaaatacacatagcacaaaagttaccatcctaaccatttttaagtgtatagttcagaattgctaagtatatttccagtgtggtgcaaccaatctctggaactttttccatcttgcaaaatggaaactttatacacattaaacaacaattccctatttcttccttccagtgaccagtctaacattttgcttttcttcctatttgacctctctgtctggtggcaaaaactatggatttctcagataactctaacactctcctacttactaaatgtttgtgcttcttgtttactaaatggatatttgtttggtagcgtcttccctctcactatcgtgctgacaggatacatgtttggtttcatgtgtcatattcccagtctcactttggtatttcacagagccagggaaggacatccagaggtcatgcacagcatttcccctgccagaggcagaaatagaaacaaactcttctatgattagaacaacaacaaaaattgcctcaatatttcacttttaaatgggccaagtgacaaacacagtcttttcactgagcaccaaattttaattacagacactcatagacatgggaaacaactgtgtccaggaatcatcttggtgaacctgtgagatttggtttgggagttaagtcctatgacaagaacaggtgcagcagtgctctcctctcaccctgtagaggtatggggaggacttcagactttaaagactctgattacatgctttccacaatttacccactcatctttccccttgggtagtattttgcgtccacatcagatattgctgacttcccacatctgctactgtcttcatccttgttgatccaatgaacactcgattttgtagtgacaattgtatcccattgatcatctctgacatttattctgttgccttggcttgtataattgaaagccagacatcgcttccctaagtgagaagcctgcccccaattggccagcagttgtcttatgactgaaaagtgacttctctaggaaaataacacaatctgtccttgataattctgttgcccagaccttagaaatggggccttggccttggcctcctgctactcccacccctttaaaggcagcgtaaaaccaaaggaagtgttggagtgttatgcaaaagaatctgtgatagagtttgttttcaaagtttagaagttttagaaatataatgttgatactttttaatgaggagcttgtttaaacatgattacgcatagggattcaggacctctattttattcttgaggcttaagtaattattggaatttcaaaggtaacttggagacaaaaaagaaagacaaaggagggttcttgcaattagtgaggctgcctgcactgtggaacactgcaggcaatggacaaggcggggtcaacttagcttagggccacacttcttcagctctggaagttctctatgctcatgaactacagctgaatagcatcttgagatcatcttttccagcggttcttcaacttttttgcaacttaagactcctgttgggccgggcgcagtggctcacgcctggaatcccagcactttgggaggccgaggtgggctgatcacgaggccaggagatcaagaccatcctggctaacacggtgaaaccctgtctctactaaaaatacaaaaaattagccgggtgtggtggcaggtgcctgtagtcccggctactcgggaggctgaggcaggagaatggcgtgaaccccgggaggtggagcttgcagtgagctgacatcatgccactgcactccagcctgggcaacagagtgagacaccgtctcaaaaacaaacaaaaaactcctgttgtctcatatttccttctcatatttccatatttccttatatgaaatccttacctatgaaataatactactagttcatacactaattaatagtcaagcagagatttttctctctcttattgatgattatatcgccaaacctagaaccatgcctagcacttagtagatgctcagtaaatattggttgaattaattatgcttattttgggccagacactgagcaaaatgctttggatgcatgatttgaaaaccaactacatatattacatatgcattaactgattttccttttaaaaacttaaacataggcataatttccatccacagttgctgagcaagaggtgaagtaataccagaaacaactacattttagatagtagctgctaccttatgtgctgatgttttggaaacgctgaaaagtcataggcctctcaggggttgcacgactccaggctggggtcattgattcattatagcattttcattttgcagacaaggaaatttagttccatagaggtttaggtgggttacacagggtcacacagcttctcggtaaaagagccaggactctgacctggtgccttgactcagggatgaatgaggaacaatagcaaatctagaacccctggttgatggttttttaagtttgagggggtataagggggaaattagatcaaaactttaatatttgtattgtacaggtcattaaaggcctcgattctgatgccagctgagtgaatcactctgtagcccacagtttaacaatgtaatctactctgctcaagttgattgtcttcattttgcatggaggagtagagattgcatgtagcagatgatgtgaacagtgcacagcttcaagtattatttattgttcccctcaaggctctgtgtggtgaatgaggcacagatagaattagaggccttggcttgattccttgaggtcacaccccctttccttctgctagacagccagcagtcagccacccaccctacaccatgatgtgatgagttccgtgactgcctaaaggatgatcttgagtttgtaactctgggccctttgcttcagacacattatggttctaacttctatgtatctagtgtattaagacaattcttctttattatcagagagtagttcatactggagaaaataatttattattgctttgctatatatgcattgcagaaatatactttaagaaggctagatatgaaaatgttccctgtatttttgtctgtgcagtagtataatctgtgattttaaatttcttatttgcttttttcttttacaatgaacacgatttgtgtgtgtgtgtgtgtgtgtgtgtttacagtgaacaagtactcagctgtcagcatataaacatttacaaatcttaaattaatgctgcccagcttggaaggtttctgatttccttgccttcggtgaatttctccctgtgacctcacagtccctttagcacttgggtgtttcccagggcagtggaagtctgtggcctgtggcaggatggtactcctggaacccacagggaccattatttaggacaggcagagccccaggtaggggtaagatgggtaggtctggctttcttccagagtcagctgtggcataaatgtccagaatggtcccccctttttttgagtctgaaataggaacccccagagtctaacagaagcacataaaagttgtcacgcagccaaaccaaaatggttcctgacttgcctgacacttgtatccattcaccactgacaaggccaacctctgatggcatagaaacttgagtggtgactatttttctcattttcttttcttttctttctaaacagatggagtctcactctgtcgcccaggctggagtgcagtgatgtgatctcggctcactgcagcctccgcctcctgagttccagtgactctcctgcctcagcctcctgggtagctgggattacaggcacatgctaccacgcctggctaatgtttatatattttttaatagagacggggtttcaccatgttggtcaggctggtctcgaactcctgacctcaggcgatccgcccgcctgggcctcccaaagtgctgacgttacaggtgtgagccactgcgcccggcctcattttctttttatgataaataatatcaagacatgaggacatcttaagaatcgccagtcatagatggtgcatctgagcagtttacgttttcttcttaccttaacagggcaatgagaggggaagtacggtggaaataagaagtgctagatgggaacctggacactggctgactctcttgaccactgtactgtcatccattgtctgtcaacaaacctttgactggatgttgccggcgcagaacatttctttttcatagatataatattgtgcttttatttttacttgaaaatatgaataaatgtgaagttgttcttcatttccaattcccatccccccatcccctgccacataggaggacttctgctgcccacctttggccccagcctttttatctggggacagtgaggacagcacccccatgcctcgtccacctggcctcacctgagcctgcaggactgtctcttgctccttcagcactttcgcctgaagtttccactctgctgcctggttcagcaactatgagaagagagagtgtgtggaaagatggtcagatttgccttttagattactatttggctgtaatttgtctacaaaacttagcaacctgctcattaacctccttaagtaattttttggaactttgaaaagaatctaagaaagcttaaaaaaccaggcccagcatggtggctcatgcctataatcccagcactttgggtggctgagctgggaggattgctggaagccaggagtttgagaacagcctgggctatatagggagaccttgtcactgaaaaaaaaaaaaaaccaaaattagtcaggggtggtggtgcatgcccgcagtcccagcaactcgagaggctgaggcaggaggatcacttgagcccaggaatcccaggttgcaatgagctatgatggcactgctgcactctagcctgggcaatagagtgagactccatttctaaaaaaataaagaaaaagaaagctaagaaaataattggtctaaaaaagttggattctcaactataaactagtggttttaataaaaaaaatagtctctagctcaagtatgaatcacaaaaaattcaacttcccaccacattctggaaccttctctagtaatcttggccaacaatcattcagcctctgctggaacctctccagaacatccccacttggtgcacttttgttagcaactgtttcttttcttttttcttttttttctttgagacggagtttctcttttgtcgcccaggctggaatgcagtggtgtgacctcagctccctgcaacctccgcctcctgggttcaagcaattttcctgcctcagccttctcagtaactggaattacagacacctgccaccatgcccagctaatttttgtatttttactagagacggggttttgccatgttggccaggctggcctccaactcctgacctcgtgatctgcccgcctcggcctcccaaagtgctgggatcataggcgtgagccgccgtgcccggccaacaactgtttctttagagtacatccagaatcattctcctagaccactgttctccaccatagcacacttgatacaataagaactatgtatgtccttggtctttgtccctgattcctgacacagagcttctaacatgcatcagaatctcctacggaacatattaaaaatgcagatgcctctcagataatatgatttaggaagtacagagtgtgactgaattctatgcttcaagaaaatacccaaaatggtctggatatcggtggcctgtggattacattttgagaagtatgggttagaagtttgacctattggtctaaatcctggcccctgagagctgatgggttaaattggaaaggggatttgggcatacaatgacacattcatatataagcttgtaattttaacttaagatgaatgcctatttatcaattttgaggtagggctgtggtctttgttttgggtatggatcttctgattagagttcagagggttttttgtttggtttttattattatttttaaaaatcacatccacagtgtgccatgtaagatttctaggttgttaggcttgtgtgtgtgtgtgtttagcgatagtgctagaacctaaaaatacttatgaagcagcttgtctggataattctctagagttttccacttccccccagtcttttatagctactcatatctagtttgacagttgttttttgccatttgcttgcatttggtctttcaaagcactaagcataatttgcacaaacagttttttgttttcatacttatatttcatcagtttatgtaacatcctgttgatttacacaaaagcaagtgcaattggaaagaaaaggtttgtgcaaagagctgattcttggtaagctccaccttactaaactggggcaaattttgtagcccttccagagagtggctgggtagacctgcaagtcagcatgctgtgggcatcggtcagtgcgttttacagagaaaacagtgaacgcagagatcaatctggctagtcagtctggaggctatcaattaagaagtttctcttgtatttgaagataagctgattaaaatttcccacttttagtttatccctattgtaaaaaaaagtccacgaggtctatgtattatataatcagaaccaaaaaaactaacaataaaatcattacttttaaaaactggaaagcttctttttcctcatctaagtttgtctttttcccatgacccagcctctccatttgtaaaatgggttgcatttgttcctctatgcctcccagggtgcaatgaagattgattctcatagaagtgcaaccaaatggtcctatgagaggactggggcagctgtggagtagaagccctacagtgtcccctctggccatctgaggggagtggtggcactgtgcctgcttcttgtgagctggctatgcagctttgttgtgattggtgacccccaacctcgagggaggctggtggctgcctattctgcctgggtgacttgatatctcatcgcttccaaaaggaggtgccccagctgcaagccaggtaggtggctagcttcgaagaagtgagatgagctccctctctttgactcaaatctgttttgctgaaccaaaacaggtgctagtttcttgctaaggctgggtcgtctcaaatctgctctccaatgtctctcatgtgcatctttgtcttgttctttctctttcatgtctcgtgttatacagcaaagtaccaatatactatgggaagcatattttacccaagaaggtaattacaccaatggtggaatttctattctcttggattgtgaataataattgaatgttttatttcttgctttcagagctaggttgtagatggatttcataaattaatctttttcttaagagaacatggacttctgatttgaaattatccaatgtccaccagattatgttgctcaaaatttgtctttttgttgccatgtttgaaaatttattttaaaattactattctaatcaactgaattgattctggtctgattttaggtaaatgaaaatctcaagatcaaaatgtgacatggccaaatttgaataagtggtccatggaccatgttttacctctctctcaccccagcaacagatacatgcgtcaactcatacctctgaaacacacgtctgagtgtgatgcaccgtcacagagagtgtgggctttgggaacagacgcacataagatcaaaacacatcttgctcagtcagcagtgtgcaaccttaacaagttgcgtatcttcttggagcctcaattctctcatctgtagaatgaccctacagctttttggggagtgcttggggttaatgagatatcaataaacaccaccactcagtttcctcagcccaaaacttaggagtcatccttgactttctccttttctctttgtcaccagcttcaggtctgtagcactgtctgttgatttcacattgaaaacaactttcatccatctccacccctcttctctgctgccatatccctaaaccaagtcatcatcatatttcatctgattgctatagtagcctcctgtcttcttgctctcttgtccctctgcagtctattttccatccaggagccaaattaatcttagaaaatgcagagcagatcatgccatcacttcctttgcagaagcacccagtactttcccattgtatttagaatgaaatccaaataactttttaagccctacaaagctacacagtttggcacctgcttacctctccaacttcattttgaacctctcccccatgctcttgcttccctgaccttttcctgtttctggagcacaccaaattggttccagcattagggcgtttgttgctgctgcagatgctggagacgatgctccaagtagcagctcctcatctggcagggcttagctcaagcattcgcccctccaggaggccttcctggtcactcaatctaaagtacgtccccttctttggccccttctcagtttctccttacttccttagtagtggtgattattgtctgaaatgacccttccctgtttgcttgtctattgcttgtctctttccagttagactctaatctccatagtgggagatgccccttctctgtcttgttcacggctatgtccccgcacctaacacggtgcttagtagataacaggcacttgaaaaatatgtgtggaatagatgaatgactattttatgtagaaagtagtgtagacatagtgcctcagactgggctggctaatttagttctccatagaagctggggctctttctccatcagtctagtgctctttgaccattataaaaacaacttgcgtccaggcgcgatggttcacacctgtaatcccagcactttgggaggccgaggaaggcggatcacctgaggtcaggagttcaagaccagcctggccaacatggtgaaaccctgtctctactaaaaatacaaaacaagtagcctgttgtggtagtgggcacctgtaatcccagctacttggggaggcaggagaatcgctggaatcctggaggctgaggttgcagtgagctgagatcacgccactgcatttcagcctgaatgacagaacgagactctgtctcaaataaataaataaataaataaatacaaaacaacttgctcagagtgtctctgacactgaggtagaccagatatgcacaacgactaaaatgataaatacatattccttttctcgtttgtgtcgctcctccgcttccttcatcatttcttgggcctgctcaagctttgcatccaccagcttctgctgcagttctctgtgtttaaatattttgtccagatgctaagaaaaataaagtgtacatagaaagcttggtttattattggtgcttaaaaatgcaaagtaaaataattcacattaatacacattccccaggttttaagatttaaaagaagagagggataaatgcattggcatcacttacagctttataataaagctgtaaattggtgaacccctccccctgactttgcaccacacacacaaagctagctataaaaggtagaggcaccagagttcagcagtgtcaatgccaaaagatccatacaatatttttctacgtttggtaactattagatatgatgctatttattatgctagacagcacagacaatgatgtatcagtatacaatatacaggggctacagttgtatcatttggtattttggctctttctgtgaatataaaaccacttttaattgcaacacttgtgcaatttatcatgatgaattctctgcattcttgcctctggcgttgtgagaaagccttggggtgccagcatgtggtccgaggtctgggagtgaggcctgagcccccctgaattctactctgttgctctggtggagatgacaaggccaagggtcatagagaaattgagtcgcaaatgtgcagagctcgccacaccttttgacctctggactagtttggtcaagagaaacttccaactctacctcaggatggataaattcctggtcactgggaggtccaatcagaaacaggacatggaattctccccttgggctttacttagaaccagtcccaggaatatacaactagcatagcagcccattcccatctgagatctctctgaagaatatggacattttcctttcactccttcctatcttctttagtctgaacctccattctggagcgggattgatccttatgacaagataaaatggtagcatggcattttggcttactattaggagtttcttgatttacctaaccaccgcgaccatatgctgttggctcagttttgtgcttgataaaatcttagcatgttaccaacagagccgctttgactatgttatgttacattttaaagcagagatttaaaatttgggtgggatagggaaaggaatatgatgtgtcaaaatcctgagagggtatctggaatcttaaaaatatattaaatattaaaatataatttgggtataacaaaagaccttgatcatccccctaatataacctattcaaagtaaaaggcttttgcctcttgtgactgtgggtaagtggtttaatctcttagcttctgcttctcatctataagatatggataatatattattatctaatgcataagattgttgagacaattaaatgccatatggtatgtaaagtacagcacttagcacattgcctgatacaaactaaccactgaataaatgatatcattattattacaatgattacattattaatactattattggcctggtagggtacatagaatacagactcttttttttttttttttttttgagacggagtctcacactgtcgcctgggctggagtgcagtggcgtgatctcagctcactgcaacctccacctcctgggttcaagagattctcctgcctcagcctctcgagtagctgggattacaggcgcccaccaccacgcctggctaatttttttttgtatttgtagtagagacgggatttcactatgttggccaggctgctctcgaactcctgacctcttaatccacctgccttggcctcccaaagtgctgggattacaggcgtgagccaccgcgcctggccagaatacagactcttaatttagatgacatggcaattcttaagagggagtgcgtgagttatttttggctatagagagaggatttttaaaaggctgagaaatattattttcaaggaaaactgtgcccacagcctatcactttctatttattgcctttactttgtagtgatgccagttttgaagaaatcccatatgactttcagtcaggtattttgtaagaccatctgtcttcattttggctcgtcaaggaaatccaatcctaaatattaatcagttgagagggctggctgtaactgtcttattaaccaagttcccacctttagctcccagatccggatctatgtactgttctaagttgtttgatgtggttctcacctcctctctgagctcatactgatcgatgatgcttttcagcttttctgcaagctctgtgttctcctgacagagcttcatatttcgctcactctgctgctcgatctggccctggatgtccgtgagggtactctggaaatggcttgtgatttccttccttttctcttcttcctcacgtgcccgctgaagcgcctcttcctgcggataaaaagcaaaacattttgtttaaatgcaccccgggtttatagaactcagcattaggtcacctaaaggagataagtgtgcagagtaggtgggatgttttttctcagttctctagagctaaagctgctcagccccaaaataaatgtatgagtaaaggtttcagctgtgagtacatagttactcagaacaggtgctgtgaaggccttgaatttgtagtcagtgatgaatagacttgttttaaagatgatgcgtctcttgctgagtgaatgaactgcagcgatttctaacaaacacacagtcacacgattttgatctcttggctgtggcctgaaaaaaaggccacttgagtttactgatggatgagacagatcatgtgtttctctggtttggtaaagggagaacaatagatcttatatttccctgtaaaaaccatggcatattaaccacataattatattaccaagttttgtaaatataagtgatcacaataaaaattttctatttgtgagaaaaaactttcatcaaaaagctttaaaaaaggaaactaagacagcatagctcaattacagccattcaagaatataaaagggaatctttccaaacatgctggatattattttgtttttgaaagaacaatcattaaatgtgtcacatagggtaattaaaatgttcaatgtaaattttgaatctgaaagcaatattaagtttcaaatcttctttaactctaaagtgaaacatctaattttccttcttccgctttgttaacattgaagaattgcaaattaacttttatatcatttctgttctcttttctcctaaatcaaaactctccattcattgctagccactaacaatgagctccaatttcctccatatctatattgagaattgctttgcgattgttattctttttgaataaaagggtttaattttgctacatcctaccaaagatagagacatttacgtggctgacaaatgatacagacattttaggattcctttcagttctgattaattgttaatatgaaagcttgcttcgttgttggcaagtaaaattatactgaatttgattgcctaccaagttcaaattatgtaacaggattttttaaaagaaataataatttttaacagaagtaattgtacagacctttatcataacagaataatgtgatccaaataaaaactgatgctgagaatatatgctctgaaaatattttatcattaggtttcttctttcctctataataacaacacatttcccaactctaatgtgactcctgatgtcagaatcataatttattcatgttataaacctttattaagcaacaacttctcaggggtattgaagatatctgtacttcttaaactgaagaaataaactatccgagatgttatttccctgaactttgtatactaacacttactatatgtgtttcgctaaaaataattatggttaccagttaggagcaactaaatatatgtgtgattatgattgtttcctcactggtcctgattagcttagaagtcagcaagtttggaatcagaactacagaccatgatttgaataccgtttgtatttataaatattccatgaatgaataaatgaaacaccccatgcaagtctgagttgttgttttttttttaattgggaactggctatagaaagaaggtacagatgataggatggcactaaataaatgtcaaacaaacaatcataaccgccaatcctggcccaaaagatgtaatcttgcatatatatatattttttgttttgttttgttttgttttgttttgttttgagatgaagtctcactctgtcgcccaggctggagtgcagtggcatgatctcggctcactgcaacctccaacacccgagttcaagtgattctcctgcctcagccccctgagtagctgggattacaggcacgcatcaccaagctcagctaatttttttatttttagtagagacggggtttcaccatgttggcgaggctggtctcaaactccagacctcagatgatctgcccaccttggccgcccaaagtgctgggattatgggggttgagccactgcccccggcctatattgtttttcaatgagaccaaaagaaatctagcaaaatcttataaaatttgagtccattgttagaaggattttcaatcatttggacagtgtctgagataaaattatcttttctttatcaaatacattattcaaagtcaaaataatgtcaataaaattgagggatgaagtctgagataacaaaaaaaccttgcaagcatcattgtgcatcttacaactggtgctgtgcctggcacataatccaaaggtattcagtaaatgtttatttaatgaatcagtgaattattaatttatgtacagacatatgagtagcttggactagatcattcctacagtcctttccacattaaaattctgtgatattctgacaacaaatgcttctcatttctttaggaaaatcatgctccctgagacacttacccctctcttactaggcagttctttttcagcatagtttgaggctcagatttatcactttgaatatatgtatgattttgttgaaacaaacccatgtctcagacttttatcaatcctttcttaagttatcctaaattgtgaggttgtatgtgtgtgtgtgtgtgtgtctgtgtgtgtgtgtgtgcgtttgactcattaaagaagcggttttaataaagaaaagtaaaagctaaaatttgtgatggcggaaatacctagttatacattgtctttctatatcttcccaagctcccagcgcatggattttagatttaggtacacttaaggtgtttcactagtgtggccaaggaagctcatatcaagttgacccttttgcaaataacaactgtaaactctggatgaaatgcaagaaacaatgatgacactagagagtaaacaaaatcagacagactctagagggaagttggcacttgtacatgagtttcctattctttatagcttttagcttgagggaaatctgcagttggcaggagtatgaggtgggcaaaattctcatataaaacataccatctttcatattagaagaataagaatacagagttctggacaactatagtccctcaacagtgaggggaagatcacccaaaaaaagagagagtcagagaaatagagcccagatcctgtgaatgaactttacacaaatctgattggccttgagccacacatgtgcaaagcagtctagctaagtagaaaagaactgaactgagatttcagctgctgctcaagagacaaagtttatggtttgaatctaaccaaattaattgtctgcttaaaaaaataaaaactattcatcatatagtagaatccagattctccagaacataatagtcacaatatccaggatccaatagacaatggcttgacatatgaagaaccaagaaaatatggcctattctcaaaagaaaagacaattagagaaggctttttctacaatgctgcaaatgtggaattagcagacaagtattttaaaacaggtattataactatggtcaatgatgtaaaggaaaatattatctcaatgaatgagaaggtagaaaatctcaggtgagaggttacatacaaaaaaagaaccaaatggaaattctgaaattaaaaatcgcaaaatctgaaacacaaccatcactggatggatttagagcagaatgaaaatgagagagaaaagaatcactgaatgtgaagatagaccaatcaaaataagataatctaaaaataaaagagaaaaagtattggtgaagaatgtgaagactgactcgaagacctgtgggacaatatcaaaaggtctacacacacagagttagaatcttagaagggaagaagatggagagaaagtggagcagaaaaactatttgaagaaataatggctgaaagaaattcaaatttggtaaaagacatataattacagatacaaaaaagcttagcaaataccaagtagggtacatgtgaaaaaaaccactcctggccttaaagcagtaaaagttctgaaaacgaaagatcaatacaaagaccttgaaaagggcagagaaaaaggacatatcacatatgggggaacaataattcaaatgattgttgattttcatgagaaattttaaaagccagtatagtggcacatttatttaaggctaaaaggaaaaaaaaaaaaaaaacccacgaataggttctctcaatgcagaattctatatccaatgaatttagccttcaattaaaaaaaaaataaagatgttttaaagataaaaggcaactaagagaattgattaccagcagatttgtactataagaaatactaaaagaagtacttcaggctgagggaaatgacatcagacagaaatgtgaagctacagaatgaataagaagtatcaggaatggtaaacatctgggtagataaaagggatatagttttgcctttaatttaagaagaaatacatattattgtttaaagtaaaaattataacaatgtctcatcggctttacaaaagtatataaatataatacatataatgatgatagcttaaaggctgagggagtaaattgatctatttagttgcagtgtttctacatgttatgtgaagtaatacaacattaactccaggaagactatgaaaaattaagaatgtatattgtaatcacagagcaactactaaagataatgtgtagtgttataatttcaaaatacaagagatgaaatgtaatttttaaatattcaaataatccaaaggaaggcaggaaaagaacaagataaacaaagcagaggtgacaaataataaataataaaatggtagacatatatcaaaccacatcagtaagtacattatatgttaatggactagtactgcaattaaagggcagatactgtaggaatgaaaagaagtaagatccagctatatgctatcttgaaagaatgcactttaaatataaagacccaggctgaaaatgaatggatgaaaagagatacaccaggcaaacaataagagtaagaaaactagagtggctaaattgatatcagataatgtagacatccagacaaagattattactggtcgggcgtggtggctcacacctgtaatcccaacactttgggaggccgaggcgggtagatcacaagctcaggagttcaaggccaacctggccaagatggtgaaaccccgtctctactaaaaatacaaaaattagccaggcatggtggcgggtgcctgtaatttcagctactcaggaggctaaggcagagaattgcttgaacccgggaggcggaggttgcagtgagccgagattgcaccaccgcactccagcctggacgacagagcgagactccatctcacaaaaaaaaaaaaaaaaaaaaagattactaagggacatttcataaaggtaaaatcaccaattcatcaagaggacataataatcataaatgtatatacacctaatattaatgcttcaaagtacataaagcagaaattgacataattaaaataagcggacaattccacaattatatgaagagatttttaactctcatttctcagcaattgataaaaaaattcaaaaaaggcataaatgatttaaagctaattgttacttatagaacactacacccaacatctgaaaaacattgttttgaagtacatatggtatcaagataagaccatgtatgatcggctataaaaattaaataacacttctaaataatccctgggtcaaagaaaaaattagaaagaaaatttgaaaatattttgaatttgaattcaaatttcaaatattgattttgacatttaaatatgcttgatcttggacaaccaatttggattgctgagtgtcagtttcttcaccaataaagtggagatattaaccttcactgggttatcatgaagattaaatgaaataatgtatataaagcacttagcataacttctggcataataataatacttaatgtcattgttcataatgagaagccattactgagggcatatgggcacacttacagggtctcctgctactttgatcattctgtctttgtttttttggtgggggagaatctctagccagttggatggtattaataagatctctctctctctctctttattttctgagacattgctctctgtcactcaggttggagtgtagtggcgcaatcataacttactgcaggctcgaacttctgggctcaaatgatcctcctgcttcagcctcccaagtagctggcactgcaggaacgtgccacactcagctaattttcctgatttttggtagagacaatgtcttgctctcataaatgttgcccaggctggtctcgaattcccaagctgaagtgatcctccggccttgggcttccaaaatgctaggattacagatgtgacccactgtgaccagctgaacattctgtctttcaatactacccaagaagaccacgctgtatcattctactctttatatctctttgttgataaatgatcccaccctatctgatttaattttatctccttactgtgtaacattactgacagacagtggatttacgcaggcacacaagagatttatgcatcctttgaatccaaaccttgagttgaggacgatgcttccatcctcaggcccccattcggcctgggagtctgtcttcagtactattgttgacaagacgccagtagcacatctaaaacctgccatttgagactttgacttcatcacactggttctccatttcccaaatatcaaaaaacaatttgggaaaatgaggaaccatgattctcttctatttttcttcctaactcaattgtacaaattcagcagtgattttcatgtactctgtttcttgaagtatctccttttaaacgcttataataataactaccttacaggaacactggtgtctgattaattattatttgtcaaaagatttaggatcttcagctggaaaggggattggggatgcacacagtatcatcttggagagctctgcatcttgctatattgaatggagctagtgtctctgtgtaatcaaattaaccacactgctagggcttacgctgtaattaatgaaacccgtgcagaccaaatgaagtgatcagtctattatttttagattgaataattaaacctgaagagcttcagtgctttttccaatagcttcctttttttcagatgactattgacattttggttctcaatctcacttcactgtgtcaattcggtgtgtgtccatttgtctcatgtcatgcagaattcattataacaccaaaaatgctgaatctttacaaatgtatttttttaaaagaactaaggcccaccttagaaacaaactcaacataatagaaaggtaaggggaatggtatgcattttatcaagggcctgcactgtgtcaggtactgtgcgggtaccttacctattcaacttcatctaattttttcccagccacacagtgaagctggtctaatctccattttacggatgaagaaagtagctcaaggaggtaaaattatttaaggttacaagcaagcaaggggcagaggcagtatttgaacccaagcctctctgattctaaaattcacactctttccatgagtagcagaggcctgtctctgtgccccattcaagaaattatgttattctgaggcatggggacataccttcagagtcttgttgtgtctctgcagctcccggcacagactctccaatttgcttcgagcgaggatagctctgctgtgttcaccttgtaactggtccttttctttttgaatttgtacctgtttcttttggaggagctttaacttcttttgctcagtacgatgttcatccagctgtacacatggagatacaaacatgaaagaaaatggcagggatctccttggagtggatagaaaaaaagcaaacctaaagattactctgtggttgtttggaaacattttttgctattatctcttcctctggaagtaaatgaaattcacaaacgtcacctttgtagtacttgaaggtatatagtttttagaacacagcattgataggtttttcattattattagtctctttttactttgatctatttttggatggtctagaaatatttttcctgagtctatctaaccaatattgaatagccagacaaaatagaaaggcatgtctcagaatctgtaaactgccagagttcatgacgatgccttgcattgaggcaatgatctaaagtctgtctgcttgggttgcattgagttttcctaattcttccttgaaacaagcttctagcgctatttttaaaaataggaaagagaaatgcagcctcctggtaaacagaagatgaagttctcttctttataatgttgggctctgagtgtggattgtttatgtgtgggaaaggagaagagaaagtacccttccactacctaagcattgacgggttttcaccaaagcatcagaaatagcttctgcatgattcaacagcatgaatagcaaatatctgtaacacgccttgttgctccccacccgcacccgctctgtgcttataacaaataaatcattctgctggtttctgctgagcccagttgaactcttctcatgttcctccagcagccacaactaaagtactgtatcaggactgccttggaacatgaaaccaacttaccgctgtactttccatcttggatgctgaagttctagggtagggttgtcagtaaaatgcaggacacccagttaaatttaaatttcaaataaataagaaataatttttagcgtaagtattaatatattccaaatattgcatgagacatatttttgccaaaaagttatttgttgtttgtctgaaacgtaaactttgtatttttatttgttacatctggcagcattattatggagttgtagacctggtgtggggagtatggggatcaacctcagaagcctccagagagagattggtggactctaggagtgtcgatctcagactgaccatcgctggggccacatccaagcagcagccctttgtccagagccatttcctccactggcctcagtttctgtagggcccagatggtgctgaagtcaggtaagtactagtcctaataacgactttgttggtgaacggaaaggaaaagccctggttcttctggacctcaggtgttctggtgcctcacagagcctaatgcaaatggatacagatgccacatgagtcctgacacgtgcctcagtttccccattttaaaaaagccattggggctgggcgtggtggctcatgcctgtaatccctgcacttttggatgctgaggcaggcagatcatgaggtcaggagatcaagaccatcctggccaacgtggtgaaaccccatctctactaaaaatacataaattagccgggcgtggtggtatgcacctgtaatcccagctacttgggaggctgaggcaggagaattgcttgaaccagggagatggaggttgcagtgagtcatgattgtgccactgcgctccagcctgggcaacagagcaagactccatctcaaaaaataataaataaaaaataaatagaaaagcagttgttctttctgagcaagatgaacacctgtcacactttcttcggttcacattttatttctttcctctctccctcctgccaccctaaaataagcattttaaacccttgccagataaagctaaggatatgtatatatgatattctatcttcatacttatgtgcaatttctagctactagtggaaattagcattgtaaaaacaaaacccatattactaaaaatattgattgaaatagatatcctccttggaaaataaataatctgttattaaatatttctcatgctaagctgctcatagtatagatgtgagcctttaattttgcaccatagttattagataggcgtgaaatttcttgtacatatatttggatttaaaatgactattgtcctttcttgaaatttatatattgtaggccaggcacggtggctcatgcctgtaatcccagcactctgggaggctgaggcaggcggatcacctgaagtcaggagatggagaccagcctggccaacatggtgaaacctcatctctactaaaaatacaaaaattagctgagcctaggggcgggtgcctgtaattccagctacttgggaggctgaggcaggagaatcacttgagcctgggaggcggaggttgcagtgagttgagatcgtgccattgcactccagcctgggtgacaagagcaagactccatctcaaaaaaaaagaaaaaagaaaaagaaaagaaatttatatattgttattattattgccattctggcgtagactttaccttctgaagattaaaccatatgtcagggcttctgaaccccagcacaagtaacatactgggccagataattttttgttgttggggctgtcctatgccttgtaagttgctcaacaccatccctagcccctacctgctatatgccagtagcactgcccaattgcgacaccccaaaatatctccagacagacatgcctattgtcgcctggtgaacaaaactgtccctgtttagggaactctgcactatgtggctttatctgagtgtcaggaggaagacaccctacaggtgtttcataaattggaaagagaaatgatttgtgcttgctcattttccatttaatgttttatttttatttttaattttaattttttagagacagcgtcttgctcagtcatccaggctggagtgcagtggcacaatcattcatagttcactgaagcctcaaacgcctagctccagccatcctcctgcctcagcctcctgagtagctgggacaacagttgtgtgccaccatgcccagctaatttttttgtagagatgggttcttgccatattgtccaggctagtcttgaactcctgagctcaagcaatctgcctgccttggcctcccagagtgctgggattacaggcatgggccactgtgcttggcctattttgtttctaatattaagccagataatactccagaactttcctttatatttaaaaaaatttaaattattaacaaagtaattcagccaatattcaagtgattcttggcattgaagacaatgaaaaatacacattccctgccctctaggttcttactgcctagcttcaatcaaatgctggctttgtgatttaacttaggcatagttcttctgtacaactgtaataggcatatagaatttctgtctgtaatttctcttgttttctttctctttttttactaagttaaaaagtaaaattaatgctaagtactaaattaaaatcctattactgatgttgtcttaactacataagaattgaggaaattaaatgtgaaaaatatttctcccaggccatttcctaatttagtcatgaaatgtccttacttattaatgagcttatctttatttattaatgaatacaatgtcagataatattacaggatttagactctgcaaggatgagtgagctagagtggcagtttgattcacagctttgaatttgatgatttattctatgtgaacacttatatttcagtcattttctatattaatatccaaatcagtgagcaaggaaataggctttagtctccacgtaaaaaattgaaattcctcataatttttcttttctgaaaaggaaatgtgataagttttttgggttaatcttctcctattcattttttctaaggtgatctctcaggttcgaaagttttttacgagagatgatacaaatgccaaaatatagcaagtaaggcttgaattgaatatggtctctggaaaaacaatctcttgtttattgggggtgactgctttgctaggaggatgagtaggtacagggagttccctgagaccaggatgaacaaccctggctcatggagaaaatatcggtaagtctggaaaagtgatgcttccccagtgcactgtcgtgggaatgtaacaccacacatcacttcctgtattagtctagaatgctgcccagtcccctcaagtatagaacatggcgctggaaactaaacatgaatggccttggtatgagttggtaaatcgaaggggtaaaggaaaaatgactcagaaaatactaaaaagagcaaggatggataggtgagaatcgcatggaaacgtgagagtgggggccagatttggggagaaaatattatttttgacacctaaattatttttatggtattgaaattgttaatagccaatgcaatacaagttgcaagaaaattgatacactgatacttgctttgtgagtttctactgctcttttggaaagcaatatggccataaagtttaaaaaccagaaagcactcatcttgtttaatttagtaagcctatttctggaaatttttcttaaaatcataaaaaagaaggaaaaagaacaaagctaatacgtgatgatgttcaatgcagaaatatttggtaaagcaaaacagtgagaggaatttaaatatattcaaattattgaatcagtagatacagccacttaatggaatatgacacaacttttacaaaatatatttgtgaagactatatattatatggaaaaatgcctgtcacgtaagaaaaccagatatcaacttatatgtaccttatgactgtaattataataaaaatctgcatacacagtagaacaggaaaagaatatgcatagaacaaagtttgtattttacatgagggattagagattttttgtttattttgtgtattcagcattatatatcttcgtgaagtagtttgtgtgtctaaaaaataatttaaaaatactgttggcagggttaagcaaacagccagtcacgcagagtttcagaatttttctggatctactgcataatagttcagcataacaggacacattaggtagaagaacagaaagattacaggactagattcagagtgaaaaacaaagaaaacaagtcacttactaaagtgtgctccatcaacagggatgaagagtttgtgggcctgaagcttattcagttttggaggccctcttcaaaataaaaaattaaagagaattaggccccgggcctcaaaggggcccatgcaagtgagatgtcctgaggtttaagcttcctcagctgcaatggtaaatctactgttgggggcagttcaacttactgcctggagggattttttgctatatgtagtctcttaagttgcattctcctgtcactgtttctccaaaagaagtaagtgaaagaatttttgttttgcctcaaactaccttttatttgcaactacatgatttcatgcaattcttctaaacaacgacataaaatagatttccttgtttataaataacttaaatatgccccatatagtacatgctgaaagttgctagaacagttcatccactcctatagtattctggtatccaacagagttgatgcacatatataaatgccaagtccaatattaaaaactcaggcaactgactaactttaataaagtttcccaaactatgtcaatatacctaaaaatgcgtatatgtacaaaagaaagattattctcaataacttctataaaaataaattcaattgtttgttccatctaacttcactactattagtatgaatttttagtgtatggtaagatttattttacctttttctcaacatgacaccaacacagtcaaaaggagctagtgaggtgctaacatgcgagaattaacccagtgattctggtcacaatgcatttcaggtagaggtacctatgtcactgggattgggtgatatggtttattttcattccctgatttagataaccaaatggatcagatagagattctgatgggcattccttcaaaagaattttttaagaagcagaaataaaggagaaggccactgcctagctttactagagagaatgccacatcttagctgtgggtctcataatctgcagggttagcgcacagacctcagatgttgctgtttacaattcattctcggattggcaggtgtttgttgttccttgaagctagaggcactgggctcactaatcgttctgagaaaagaagctaatccaagatcttaccaattcagcatacttcttgaataaaaaatcaaacttttcttccggtgtttgcaacttgttcagattttgcattagcaggttggcttctttgccttaaaaaaaaaagacatgaaaaaaataagtgttgaatttacagtcaggtgataagggctggagtctcagattgaccacttgctaattattcccaaccttggctaagccattcatcttatcagatgtaattttctttcctatagaaatgatgacacctaccttacagagtgaacattagttgggaagtttgtgaatgtgtggtacggtgtgaggttcatggcagactctcaataaatgtttgctataacagaagtctcccagttttcatcacaagaatccgttcttatttctcctccctgtattcttcagaatcaaaagattttatacatcaaaaatactttctgaaagaatacgtcacccgttttcccacttgaattaacaaaaaggaagcaaaacagccaatcaaaatttccgactagtatgaaacagcaacacggagttgctgggattccagccagaagcagagaagcttgatgaagtagcctgcccgttttttcccctgtgttttttgttcttttggtacttcttttccctcttttagggggaaccaagtttctcttttttgtacataaacccattccctggcgttggagtgggaataactctgatcctgtttcctaccaaatagaataaaatcattatagaaggaaaaccaagtaaagacatggagagcctttccacaagcctttttctgtctctgtgataatggacacagccttctctggccttcctttcccccacctaggccttaatatccgttggcagtttcattttgtttccagttggagtttatgctacactaaaaaaaaattaaccctgttaaataatcatgaaagggtggggcatttttcccatccctacctatctatgaaaaccactctgtttaatcagaatagggtggtcaagccacacaacaaagcccacacttcctgacataaatctgcttaagaaaattgacaacctttcccccaagaacagacatttccccttggctagagtacttgctttcatcttggagaggcatatatgtcatgaaattaggattgccagatgaaatataggacatggggcatatttgtactaaaaaatgattcgttgtttacctgaaattctaatttttctggacatcctgtattttcctttgctaaacctggcaactttacatggaatcaaggaattttaggtctagaaggaatttcaaagagcatccagactaaccggttaattttatgcattttagtatttaaggcccagaaaagtccaaagttacatgattagtgctggcagagagaaggcttgaatccaaggctagcctacttgttctaagtcactccactctcatgtggaattctgatgctagagagacctagagaaatagaaggcaactttttttttaaatgacctcattcccaacagttagttttgtctatctttgcctagtgagtcagttcagattagcctaaaacaggggaaggtgggtgtgagtagggtccctcccagctctccaattatggcctgtggcatttgcagctgataatcactgacgcctcgcccctgccaggcatgtgctttgggttatccctctactgacagggatggatttgcattggtcaggccatcccttcacctttgtcttcagtccagggaaggtgcccacatgaagactacaatctcaagttagagtgtcatctattaaagtcaagagactactcttgatcattcttggcccaggatgcaacacagtgtttggcccatggcaagtgctcagtaaatgatgataataatagaataaaacaaagctggccaggcacggtggctcacgcctgtaatcccaacactttgggaggctaaggcgggcggatcacgaggtcaggagatcaagaccatcctggccaacatggtgaaaccccatctctactaaaatacaaaaacttagctaggcttggtggtacatgcctgtagtcccagctactcgggaggctgaggcaggggaatcacttgaacccaggaggcagagattgcagtgagctgagattgcaccactgcactccactgcaaaaaacaaacgaacaaataaaaaaatcaaagccaactagctcaaactcgtatcatgtgaatcaaataaacactgtcatgaaaacaattttttgtgaccaactagaggaaaaacaggtcttactctcacctgtgatgttttatgtatcctggaatacctctcagtgtgtgtaccgacatgtgaaaccattacctgtcttgtttgggagagatagaaatgagtgagtccaaaggttcttgctttcttcccacattaagtatcttctcccctttggttttattttctgtgactgtgagaagaggtttctttttggttttgtttgttttgttttttactcttcacactcactgaggtctctttctgctctactgtgttattttgtatagaaggttaacatccaggtgcatcaatatgccttcaaaaattattcttcccttcaacaaaaaatccaggaaacagaatttctatttgtaagtctcacaggaaaagcactaaaactggagattaattaaaaaaaatccaggaaactggagatgggcatgtgcagaattcataaatttacaacatcactgacctcagtttttaaacttccattggtgttgtgggactagggtgctatgtgaagtaatcatggaggaggggagtagacagagacttgctcatcatctacaaaaggctatcattacatctccatggaaatagggtcatttggtgacagtgtcaaacaaaagaggaaaaactgactttattcagggacgctttatcaggaaggaatcacctgccttctccctaatgtgttcttccaaagcaagcttcatttcttcctcatgaaagctaggaaggcatgtgggcatgtagccaccacactgcgaaatgctcagcgtggtaggaagtctacatgaaagtggaaccacctgtgtagcagacacagcgctgttgcataaggctgtggtcactggcacagttttattggaaggtggagaaattatttttacatcaaagaaacaaaaaaactggccgagcgtggtggctcatgcttgccgaggcgggcagatcacgaggtcaggagatcgagaccatcctggccaacgtggtgaaaccctgcctcttctaaaaatacaaaaattagctggtgtcgtggcacatgcctgtaatcccagctactctggaggctgaggcaggagaatcgcttgaaccagggaggcagaaattgcagtgagccgagactgtaccactgcactccggcctggcaacagagcaagactctctctctaaaaaaaaaaaaaaaaaaaaaaaagaaagaaagaaagaaacaaaaaacctgaaattaaaggcaactaagccagctgcagaaatgtggaccaggatttttctgaaacttttagcatagtaatgattgtttatactaagtttggtgacaacttatgcagatttaatgtgttcaaatcaccagaggtcgggagaaccagcctggccaatacatagtaaaaccgcgtctctactaaaaaatacaaaaattagctgggcgtggtggcgcacgcctgtagtcccagctacttgggaaactgagcaggagactcgcttgaacctgagaggcagaggttgcagtgagctgagattggccactccactccagcctgggggacagagcgagactccatctctcaaaaacaaaagtatgccttttctcttccaaaattttttttttagaactttggggttaaatttcattataaatacgtacttgtgtacctctctaaccaccttcctgatttccatgaattgtggcagaaacttaaagccagaaaagactgtgaatgtccctctttcaaatgttagacctagatttatatttcactgttagttttgtttttcttctaataggatatgatttctaaaaataagcatgagataaataattcctgagcatctatagatatcttttaagggaagtaaaattcatgtatgcaggggataggaaggaaagtattattaaattcacactggattaaggataggagacctgggttccagaaccaactctgccatcaactagttgagtgatttatttatttatttttttatttttttatttttattattttgtgtgtgtgtggactctcaaactctctggctttaatttccctgtctataaaattagtgggttgactaaatggattctgagttcaacctttaagatttggtcatttcacaactaaaatagctttcaccatttttagcttgatttagataacaatgaaaacaaaagcaacattgtttggatggcatatttgttatcttagactattatggtccacttttttaatttacaaaggttctcttactcctcactgtcaccactcattgtcagggttttcatttgcttgtttcgtttggttttaaggcctgtatcagcttcgaaaataccacctagcctgtgttttcttgtcagattttgttccctttggctgacattttctatctcttatctttcagtggccttgtcatatttgtaggggaactttggcctctcactcagtaggagagtggatctggagttctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtatttttagtagagacgggttttcaccgtgttagccaggatggtctcgatctcctgacctcgtgatccgcccgcctcggcctcccaaagtgctgggattccaggcgtgagccaccgcgcccggccctggagttcttattaggtcaacagtgatgatgtgtatacactattaccaataacaaaaataaaaatattagaaaaaacagtaaaatattcatccatccactccctaccttggtcagaagagagtactaataattttcctcaaggcttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcggtggctcacgtctgcaatcccagcactttgggagggtgaggtgggcagatcacttgaggtcacaagttcgagaccagtctggccaacacagtgaaaccccgtctctactaaaaatataaaaattggccatgcatggtggcacgtggctgtaatcctagctacatgggagactgaggcagtagaatcgcttgaacctgggaggtggaagttgcagtgagctgagatcgcaccactgtactccagcctgggcaacagagtgagactttgtctcaaaaaataaaggaagactatgtaaatggatgtctgaagacatttcagaatactgatgtcctagtcaggagcctctcagaaggtaccactgaagctcacttgtaactagaaagacaaaattcattaactgaggtgtaataaatgctccttaaccaatatgatgcttgcttctgtaccactttggtcctgcgatgtcagtgacacaaagtccatcccttgctttatgactaatctcacaatcacatcaactagatgagtaacattttttggtggattctgaaactccctaggcttcaatttccctgtctataaaattagtaggttgactagatggattctgagctcagaatagccctgtgaatgagctttgtttttctcccagcccacataatgttgtcaaagaagtgataaatgagagatacctctgagcctggaggatgcgagtaggagaacaaaggggatactttagatgtgaacttggcatggtgccgcataatgggaaatctgttttcatttctttcatttcagatgccaaggggaaagtgactttacccacgagagagatttttaaatattcccccaactgctccggtaagtactgcgtttattgtaggagaaagtgcagcctcaaaaggaaaaagaagtcctgggagcttaggttgtagagacatttcccaaatattcaaggtgttctgtaaaaaaaaaaaaaaaaaagccttggccaggcgtggtggttcatgcctgtaatcccagcactttgggagaccgacgcaggcggatcacctgaggtcgggagttcaagaccagcctgaccaacatggagaaatcctgtctctactaaaaatacaaaattagccgggagtggtggcacatgcctgtaatcccagctacttgggaggctgaggcaggagaatcgattgaacccggagggcggaggttgtggtgagccgagatcgcaccattgcactccagcctgggcaatgagagcgaaactccgtctcaaaaaaaaaaaaaaaaaatgtctctcatagatccaatcagtcaataagttttggaaatgatggaaactatgcccatcactattttagatcttcattgtgtatacagtaaaggtcagagaattctggcagtaaagaaactgtttaactttgtgaaatctcaagcatcccaaagtagacacactttggaaaatgttgtagtagagagtcaaaacattttagcatctcaaatgtgccaataaagcaaatagcatctaataaatacaatgattaaagacatctttgatcaagtacataagcaaaatctaagaatatatcttcagatatgggttgaatgacttattaaaattctctaagaggtccaaataggttataaaaggagaccacagccagatgtttatattttctccaaaagagcagagaaaacactttctgaagaatcagaaccattgcttccacaatctgtgtcaaaattacccagggtgaacatctcccatgctcgcctaaaaattttcctgttcctgctcttgcacttacactatatgacaattagcttatgtgtcttcttcttcctctctacctagagatccttgactaaaggccatgacttatttatctttgcgcacctagcacagtgcatcataaagactaggcattaataaatactcattgtgggccgggtgcggtggctcacggctgtaatcccagcactttgggaggccgaggcgggtggatcatgaggtcaggagatcgagaccatcctggccaacacaatgaaaccccgtctctactaaaaatacaaaaattagctgggcatggtggcacatgcctgtaatcccagctactcgagaggctgaggcaggagaatcgcttgaactagggagctggaggttgtagtgagccgaaatcgcgccactgcactccagcctggcaacagagtgagactctgtctcaaagaaaaaaagtaaataaataaaaataaataaataagtactcattgaggacgtgaggataggtagaaatttctaggcaaagaaactagaatgtgcacaggccttgtgggagatggcgtatagcatgttcaaagaactgagaaactagatcatgcttcactccaggcctacaaactccaaatatctgtgtgtgggggctcaggaggagcatttttcacaaattttgcaattgattctaataaacagttaagttggaaaaccattagtctagacgatagcacagtaccatttaactgaaaagtagctaagaaggctgccaaagctacttgcaaacaactgaaagtttaaaatggtggttacaagttgaggttagcctaaaaatgttgttttcatgcataatgtagctgttaaatagtacagtgtttaaaataatatgctaatgatgatgagtgggaaggcacagaaaggtcatgagcccacacatactcaattagagtggacacacctaggtactctaatccacaagcattgattttggtcaaacacagtcagttggaatttggtatcgtaaatagcggcagaattagggagttggaatttttaaaaacatcatcctgactatttggtaattgtaaggttaatgcagattatgaaataactcatggaagagagtagaaacccaaattggttattttaactttatccctattttcttcatatctttcccctcaacacacacacacacacacacacacacacacacacacacacacacacaccccaattcttatgtaaaagttttagggtgattgaaaaataacttttctggttaggaacacttgaagttgcttacctctggaatgagattttgtatattgtcttacggaaacttgaataatgactaactttgcaaagggacacatttgagatgttttgtcagagaagaaaaaattgctctgtaacacagagcaattttattatgtttttccatgttccaaaacactagagtgattccaaccctgcactttggaacttgaagatacttaaaagttattatctgagttcttttaattttatcctagttgggtgaagtatgctacctgaatgtattatttaggccttcttgaaagcattgtagcaatgggttttagcatcatagcgatatctgtaggaaaatagccccttgcatggcaagagtgatgccatcgtaaagcaaacctgccatgatgaccaatgtttgactcctccataccaaggtgttctgcagcagatatctccaaccctcaggccacggactggtaccagtcattgtgggctgcataatgggaaatctgttttcatttctttcatttcagatgccaaggggaaagtgactttacccacgagagagattttacccacgagaggcctctatcagtttcgaaaataccacctagcctgtgttttcttgtcagattttgttccctttggcttacattttctatttcttatctttcagtggccttgtcatatttgtaggggaactttggcctctcactcagtaggagagtggatctggagttcttattaggtcaacagtgatgatgtgtatacactattaccaataacaaaaataaaaatattagaaaaaacagtaaaatattcatccatccactccctaccttggtcagaagagagtactaataattttcctcaaggtttttctctccccttccatctgcttctgtaaactctcctccctgtcaaggtctggtctaggttctagcttctctatgaatctacctgtcaagctttgtctctgcttattcctctttcccttgaatttctctggtcttcttatcatctccttcagaaaatttagtctccttcagaaaataccatctccttcagaaaatatcaaagctgcagtttattactctctcagagaaactagaaatcaagctaaaacagatgaaacagactatctgggagagtgaccggaccgttcaaaggaagactaggggccgggcgcagtggctcacgtctgcaatcccagcactttgggagggtgaggtaccagtccgtggcctgttaggaactgggctgcacggcaggagatgagtggcaggcgacagagcaaaacttcatctgtatttgcagctgctccccatcactcacattaccacctgagctccacctcctgtcaggtcaacggtggcattagattctcataggagcgtgaaccctattgtgaactgcacatgcaagggatgtaggttgcatgctccctgtgagaatctaatgcctgatgatctgtcactgtctcctgtcacccccagatgggaccgtctagttacaggaaaacaagctcaaggctcccactgattctacattacggtgagttgtataatcatttcattatatcttacaatgtaataataatagaaataaggtgcacaataaatgtaatgcacttgaatcatcccgaaactatccctccccagtccatggaaaaactgtcttccctggtgccaaaaaggttgacggctgttctgcagcaaggtctttaaacaatgcctgtgacatagacaatccctcagaaagatgcttatctaacgttcccagtggtcatgacttttggcaagaaagttggagatgtgaccagctgcacatgactttacctaaaagcttgctatgtaaaggacactttctggagagtgggtgtaggaattcactgtctcactgctgcccaagacagcactactgtttgtaagcccctattaaatatttctttctgagaaagtggatttgtcagcctctgtttttggccttcagctcccttggcctttgtgggtaggtttgtatatacctgctcactgcagaaaaatattctactccagtttgtgatatatttgggtttacagatagtctggttactggagtttgaacccagttctgactccaatgctcatgatctttcactctaccacatagtcttccagaaacaaatcatatgtggtctctgcccttgatagattctccatctagcatgagagatgggtatataaacaaatgattgctgcagaaaatttaatagaaaactaaggaaggtgatgctaactctacctgggcatgtcagggaaagtatcacataggagggagtattcgtagtgagtgtttccaccaggaaagacaagcagagggactttcctatgtacagtaacatgcttcactcatagttttaaaaattaacgttctcacccttttttcccagccatcgttggtgtcaccaatctcccatgctctcctaaaaaattttccttttcccgtttttgcacttctcctatataattaatttacatgtcttctgttttctctatacttacagctccttgaccaaaagaccatgatttatttatctttgtgcacctagcacagtgccttacaaagactaggcattaataaacactcattgggcacctgaagataggtacagatttctaggtaaagaaactaggatgtgcacaggccttgtgggcgatggagcatagcatgttcaaaggcctgaaagacaagatcagaatgactagctattaggcagtagtggtggtggtggtaatagaggcagagtgttcaggaaggtgatgttgtagggtagagtaatctgagataaaactgggactggttggagttagaccattaggatcttagagaacatgttaaagattttggtcttcatcctaagagcagtaggaggccacggaacaaagggtcaatgggtaacacactgaaaagttcacctgagctccattgaggggtaagggctggggacaaatacaacaagggaaaatatagaaggctactacagtcatccaaatattggatgtggcttttagtgaagtttggaagaagtgccccttttttaggaataccatacagaaaagtcacatatttgaacataactacttgcctaatccttttaggattttcttttccaatttttgctccttattgctgacgggctctttgacagtgggtggctctccagaagcaacgggttctcttccagcctcttcagttgtttcctcacagtccccatcctcgttgtcaggtgattctgcattctcaggctgctcactggccctggcagagccctctttccctgctgtgctggcagcagacccataagtgttaatgatgtcttccagctgtcgattcagctcttcagagatatcggggtgcacacttgcctctttctctggtggttggactggggttggagaatcctggccatcttccttctccaggccattgtgactgggtaatgatgaactgtcacctggaggtgttgactgtcgttccgctgagagctgttcagagtgattagcctccatcttgggagtagtatctagtggtaagcacagttaggctttatgtagctaacctacttgctacatatcaatgctacatttcaatggtaaggatatcccccaagtgaataccaactaattatagtctctaacgtagagaaaggcaatgtcctttcacaaaccattgatgttactaagggaggagaccacccctcatatcgtcttatgcccaatttctgcctccaaagaagaagtaaaaactaaaacgcagacatgaaatccacaggcagacagcctggtgccgcgccctgagcctggtagttaaaaattgacccctgacctaataggttatgttatctatagattacagacattgtatagaaaagcactgtgaaaatccctatcctgttttgtttcgatctaattaccggtgcatgcagcccccagtcacgtaccccctgcttgctcaatcaatcacaaccctctcacgtgcacgcacttagagttgtgagcccttaaaagggacaagaaatgctcactcagggagctcggctcttgagacaggagtcttgctgacgctcccggccgattaaactgcttccttctttaactgggtgtctgaagggttttgtctgcggcttgtcctgctgcattacaattattaaagtagggacagtggaaagttgtttttccaaatcaagtcacactgctggcatatttttggttttgatcttcagttttcagtagcattccttattattcacattaagaaagtaattcatgctatttttctttgtggccatatttgtcattttgcttacactagtcagtttgtgttaccattttcctgtataattctatgtagattaacaatcactgggggtacatgactgtatatatttaaaatgtttaaatataaagtggtattagttttctttcaaagttaaaatatttaatagaagagccattgaatttatttaaataactcataagaataacatctctaagctctatttgatccataaatcaatattttgcttagtgtgaatattttgatgtaaatgcattattacactggatagaggagacatttctcacttttctggcattttctttttcagataagcaacacgaatgctttttttgaggcttaaactggcatcatttttagattaagacagggaatgagggaaggtataaataaatagacaaagtagtatggaaacacgggccaggtgctgtggctcatgtctgtaatcccagcactttaggaagccgaggcgggtggatccttgaggccaggagaccagcctggccaacatggtgaaaccctgtctctactaaaaatacaaaaattagccaggtgtggtggcgggcaccggtagtcccagctacttgggaggctgaggtatgagaattgcttgaacttgggaggcggaggctgtagtgagccaagatcgtgccactgcactccagcctgggtgacagagcaagacttcgtctcaaaaactaaacaaaacaaaagcatgatgatacttataacaacaattccttaaatttctataatactcttttattccaatatataaaccaattttttaaaagagaaaaacagattacaactttctcttctaagtcaggaagctctagaaaaacttaatgatttttaagaagtagcaatgtttcataaacaaggaggagaccaactcgagaaataattcagcaataataagggcccttaggaaagggtgagagatggtactgagtcagagattccagggtttctgactattaccacttctagagttgcaatagatttggtttaggcctttaagttatggtgcattttatttgtaaataatatttaacagtgatgctgctaaatagcagcataaaaatgtggcaagatcctcataattcacaggttttgctgttgtggtaacatgaaagtgaaaacaaaagcatactgttctacaactgcacagcttccttttcctgttctcagggcagtagatgtcaattgaatgctcagacaccaacaagaacagaaaattcaacacacagatgttgccactgacttgtgatgctcaccaaacactcataacttagaggaagtactttttttctttcactggtttgaattcaccaacttgattatcaaataatgcagcagtttcattattttcatcactgggatttcttttcctgacctcacttgttgattgcactcatctatatataacttaggcctcccctgaacacggagaaagacacacggcacctgctgtccagccagaagttattttaagctattctaaaatgagtcatgccgtttagcacttcatccttgaaaatcaagagaatcgtttttcagtcaaattgaaaacagtaaacatttagtggcttaaatccatacatgggttttaaagtcggggagactatcttaggatgaaataaaatctcaagtaaaatgaacttcaaaataattaatttaagataagctgtccataggagttttacttcggttagtctaaatgcaagtggctgtttgtatttgatttattcttcatgagatgccacaatcattgattttttaaattcttaattccatggctattctttaaactcctgttccacatttactttaaaacagaacagtcattataaagcccaggacaattcaattcccaaaagtagcctcaagacaagttaacaagagggaaaaaaacaaagtcagagaactttgttacttttcaatcatccattttatattatgtggcaaagaaattatttctaacttttatcttatataaactttattgccttattttcccctccccagggagagaacttttcacttgtgttggctattccagatgactatcacagacacatccctccctaagcaacacattttatttataaatacaacaatgaaaagttctccaacagttcactggcaatctcaaagttgcaagtttcgaacaccacaaaccgcaccctataccttctcacagggcttgggggagtgtttgtcatacttaccagaaggcaagaagctaagcaagaagagagaggagaggaaggaggcaggaaaaagcaagtcagagctgcagcaacagcaggagagggcgggctggctgtgttcttacaagggagagagaaacccaatacacacacacacacatacacacgt

SEQ ID NO: 995 - DNA, 963 bp, Homo sapiens
ttaaaagttatgagaattgtcctttcccttaagaaagaacctaatgacactttctcgtacctgcctggttttcaccccatacacaatagggttcattgtgggaggcattagtaggtagagattagccataataatatgtatgtgtagaggaatggtgtgtcccccaaaatggtgtgtaaagaaggtaaagaaggctggaacataggtgaggactatggcacagaagtgggcagtgcaggtgctgaaggccttctgtcgagcatctgctgatgatagactcacaactgcttgaagaatcatagtgtaggagattgtaatgcacaggatatcaaagcccccaatcagcagggcaactatcaaaccatagatggcgttaaccctgacattaccacaagatatcttggccacagacatgtggtcacagtaggtgtggggtatgacgttgcccttgcagtatggaaggcgcttggtgaggaaagtggaagggataacaagcatcacacccctaagaaaagtgaggaacccagctttagcaatgactgaattagtgaggatggtggcataacgcagagggaagcagatggccacacagtggtccagggccatgagcatgagcaccccagactccatccctgtgaaggtgtgcacaaagaacatctgggcgaggcaggctttaaaatcaatctccttgagattaaaccacaatatgaagagagtgttgggaagggtgctggtgcacatgagcacatctgtgaaggaaagaagggcaaggaagacatacataggtctgtgtaaggcctcatcacagtagatgaggtacataaggccgaagttccctgtaatagcaatgctgtacatggtacacagtgggaaggagatccacaaatgcacatcttccaaaccagggatgccatttaggatgaatgaagctggagttaggctggtgccatttagaaatgacat
